United States Patent 11,044,924 (METHODS FOR SUPPORTING GRAIN INTENSIVE AND OR ENERGY INTENSIVE DIETS IN RUMINANTS BY ADMINISTRATION OF A SYNTHETIC BIOENSEMBLE OF MICROBES OR PURIFIED STRAINS THEREFOR) - sequence listing, part 2

SEQ ID NO: 4352 - DNA, 490 bp, Unknown
  Ascusbbf_1593942, encodes 16S rRNA
agagtttgatcctggctcaggatgaatgctggcggcgtgcctaacacatgcaagtcgagcggtaacatgctttgcactatcgttttcttatcttaggatgatgtttaaatatttaaatttagacctaggtatcaaaggaagcgggagtgcaaagtgatgacgagcggcggacggctgagtaacgcgtgggaatctgccccaaagtgaggaataactgcccgaaagggtggctaataccgcatatggtcttcggattaaaggatttatccgctttgggaggagcccgcgttagattaggttgttggtagggtaatggcctaccaagcctacgatctatagctggtctgagaggatgatcagccagactgggactgagacacggcccagactcctacgggaggcagcagtgaggaatcttccacaatgggcgaaagcctgatggagcaacgccgcgtgaaggatgaaggccttagggttgtaaacttctttt

SEQ ID NO: 4353 - DNA, 490 bp, Unknown
  Ascusbbf_1497048, encodes 16S rRNA
agagtttgatcctggctcaggattaacgctggcggcgtgcctaatgcatgcaagtcgaacgtggtcccttcgggggcaaacgtggcggacgggtgaggaacacgtggggaacctgcccatcggtggggggtagcccgcggaaacgcggggtaattccgcatacgctcgcttcggggtagccgaggtgaggaaagggtcttcggactcgccgatggaggggcctgcgtccgattagctagttggtggggtaacggcctaccaaggcggtgatcggtagctggtctgagaggacggccagccacaggggaactgagacacggtccccactcctacgggaggcagcagcaaggagttttccgcaatgggcgaaagcctgacggagcaacgccgcgtgggggatgacacctttcggggcgtaaaccccttttcttggggacgaagcagtgacggtacccgaggaagaaggcccggctaactacgtgccagcagc

SEQ ID NO: 4354 - DNA, 490 bp, Unknown
  Ascusbbf_1377244, encodes 16S rRNA
agagtttgatcctggctcaggatgaacgctagcgataggcctaacacatgcaagtcgaggggcagcacatgaagtagcaatacggatggtggcgaccggcgcacgggtgagtaacgcgtatgcaatctacctacaacaagggaataacccgttgaaagacggactaataccctataaaacaggggtcccgcatgggaatatttgttaaagatttatcggttgtagatgagcattcgttccattagcttgttgtagaggtaacggcccaccacggcaacgatggataggggaactgcgaggtagctcccactcactgagactgcgacaagaaccagactcctacgggaggcagcagtgaggaatattgggcaatggacgcaagtctgaaccagccacgtcgcgtgaaggaagacggccctacgggttgtaaacttcttttgtaagggaataaagtgagtcacgtgtgactttttgcatgtaccttacgaat

SEQ ID NO: 4355 - DNA, 490 bp, Unknown
  Ascusbbf_1346970, encodes 16S rRNA
agagtttgatctggctcaggataaacgctggcggcgcacataagacatgcaagtcgaacgaacttaatcgaaagtttacttttgaagcggttagtggcggactggtgagtaacgcgtaagcaatctgcctatcagaggggaataacagtgagaaatcattgctaataccgcataagctgtgagtatcgcatgatacaaatagaaaaggagcaatccgctgatagatgagcttgcgtctgattagttagttggtggggtaacggcctaccaagacgatgatcagtagccggactgagaggttaaacggcaggattgggactgagatagagcccagactcatacgggagggaggaggcaggaagattgcgcgaaggaggaaactctgacgcagggacgccgcgtgcaggaagaaggttgtcggattgtaaactgctttagatagggaagaaaaaaaatgacggtacctatagaataagctccggctaactac

SEQ ID NO: 4356 - DNA, 490 bp, Unknown
  Ascusbbf_1325008, encodes 16S rRNA
agagtttgatcctggctcaggataaacgctggcggcgcacataagacatgcaagtcgaacggacttaactcattcttaacgattgagagcggttagtggcggactggtgagtaatgtataagtaacctgcctatcagaggggaacaacagttggaaacgactgctaataccgcatatgccacgagaatcacatggttcaagtgggaaaggagcaatccgctgatagatggatttatatctgattagctagctggtggggtaacggcctaccaaggcgacgttcagtagccggactgggaggttaaacgacgacattgggactgagatacggcacagactcgtacgggaggcagcagtcgggaagattgcgcaatggaggaaacgcggacgcagagacgccgcgggcaggaagaaggttttcggattgtaaaaggctttagacagggaagaaaaaagacagtacctgtagaataagctccggctaactacg

SEQ ID NO: 4357 - DNA, 490 bp, Unknown
  Ascusbbf_960112, encodes 16S rRNA
agagtttgatcctggctcaggatgaacgctagcggcaggcttaacacatgcaactcgaggggcagcggggagtagcaatactttgccggcgaccggcggacgggtgcgtaacgcgtatgcaacctacctattaccgggggataagctggagaaattcggtctaacaccgcgtaatacgagataaggcatcttattttgttgaaatggttaaggtaatagatgggcatgcgtgacattagctagttggtagggtaacggcctaccaaggcgacgatgtctagggggactgagaggttaaccccccacactggtactgagacacggaccagactcctacgggaggcagcagtgaggaatattggtcaatgggcggaagcctgaaccaaccatgccgcgtgcaggaaggaggctctaagagttgtaaactgcttttgtacgagggtaacagcgggtacgcgtacctgtatgaaagtatcgtacgaataaggat

SEQ ID NO: 4358 - DNA, 165 bp, Unknown
  Ascusbbf_1307, encodes 16S rRNA
agagtttgatcctggctcaggatgaacgctagcggcaggcttaactccgtgccagcagccgcggtaatacggaggatgcgagcgttatccggattcaagagtttgatcctggctcaggatgaacgctagcggcaggcttaactccgtgccagcagccgcggtaat

SEQ ID NO: 4359 - DNA, 487 bp, Unknown
  Ascusbbf_29114, encodes 16S rRNA
agagtttgatcatggctcagaacgaacgctggcggcaggcttaacacatgcaagttgaacggtattgttgagtagcttgctatttaacaagagagtagcgcactggtgagtaacacgtgggaacgtgccttgaagtgggggacaacagagggaaacttctgctaataccgcatacgccctgagggggaaagatttattgcttcaagatcggcccgcggaagattaggcagttggtggggtaaaggcctaccaaacctacgatctatagctggtctgagaggacgatcagccacattggaactgagacacggtccagactcctacgggaggcagcagtgaggaatattgggcaatggagggaactctgacccagccatgccgcgtgagtgagaaggtcttcggattgtaaagctctttcggatgggacgatgatgacggtaccatctaaagaagccccggcaaacttcgtgccagcagccgcggtaat

SEQ ID NO: 4360 - DNA, 482 bp, Unknown
  Ascusbbf_44032, encodes 16S rRNA
agagtttgatcatggctcagaacgaacgctggcggcacgcttaacacatgcaagtcgaacggggtatatgggcttgctcatatacttagtggcggacgggtgagtaacacgtgggaacatatcctgtagtggtggatagctctgggaaactggaggtaatacagcataagctcgagagaggaaagatttattgctataggggtggcctgcggctgattaggtagttggtaaggtaaaggcttaccaagccgaggatcagtagctggtctgagaggacgaacagccacactgaaactgagaaacggttcagactcctacgggaggcagcagtggggaatattggacaatgggggcaaccctgatccagcgatgccgcgtgagtgaagaaggtcttaggattgtaaagctcttttgacagggaagatgatgacggtacctgtagaataagcaccggctaactctgtgccagcagccgcggtaat

SEQ ID NO: 4361 - DNA, 490 bp, Unknown
  Ascusbbf_137609, encodes 16S rRNA
agagtttgatcctggctcaggactaacgctggcggtgtgcttcatacatgcaagtcgagcggggttggtagcaatactaacttagcggcggacgggtgcgtaacgcgtgaataatctgcctctttctggggaataacagcaagaaattgttgctaataccgcatatgaccacagttcggcatcgaacaggggtgaaagatttatcggaaagagatgagttcgcgtactattagctagttggtgaggtaatggcccaccaaggcaacgatagttagccggcctgagagggtgaacggccacactggaactgagacacggtccagactcctacgggaggcagcagtagggaatattgggcaatggaggcaactctgacccagcaacaccgcgtgaaggaagaaggtcttcggattgtaaacatctgttgtgagagaaaaagaaaacgatggtatctcacgagaaagcaccggcaaactatgtgccagcagcc

SEQ ID NO: 4362 - DNA, 490 bp, Unknown
  Ascusbbf_468522, encodes 16S rRNA
agagtttgatcctggctcaggacgaacgctggcggcgtgcctaatacatgcaagtcgagcggacttgatgaggagcttgctcctctgagagttagcggcggacgggtgagtaacacgtaggcaacctgccctcaagactgggataactaccggaaacggtagctaataccggataattcacgctgctgcatggcagtgtgatgaaaggcggagcaatctgtcacttgaggatgggcctgcggcgcattagctagttggtggggtaacggcctaccaaggcgacgatgcgtagccgacctgagagggtgatcggccacactgggactgagacacggcccagactcctacgggaggcagcagtagggaatcttccgcaatgggcgaaagcctgacggagcaacgccgcgtgagtgatgaaggttttcggatcgtaaagctctgttgccagggaagaacgtccttaagagtaactgcttaaggagtgacggta

SEQ ID NO: 4363 - DNA, 490 bp, Unknown
  Ascusbbf_231232, encodes 16S rRNA
agagtttgatcatggctcaggatgaacgctggcggcgtgcttaacacatgcaagtcgaacggagttaggcgctggtctgatggcagcttgctgcaggatttccttgcttaacttagtggcggacgggtgagtaacgcgtgagtaacctgcccttgagtggggaataacgttctgaaaagaacgctaataccgcataacacatatttgccgcatgacagatacgtcaaagatttatcgctcaaggatggactcgcgtccgattagcttgttggtgaggtaacggctcaccaaggcgacgatcggtagccggactgagaggttgaacggccacattgggactgagacacggcccagactcctacgggaggcagcagtgggggatattgcgcaatgggggaaaccctgacgcagcaacgccgcgtggaggatgacggttttcggattgtaaactccttttatgggggacgaaataagacggtaccccatgaat

SEQ ID NO: 4364 - DNA, 490 bp, Unknown
  Ascusbbf_713368, encodes 16S rRNA
agagtttgatcatggctcagattgaacgctggcggcaggcttaacacatgcaagtcgagcggtagcacagagaagcttgcttcttgggtgacgagcggcggacgggtgagtaatacataggaatctgcctggtagtgggggacaacagttggaaacgactgctaataccgcatacgccctacgggggaaagcaggggatcttcggaccttgcgctatcagatgagcctatgtcggattagcttgttggtgaggtaaaggctcaccaaggcgacgatccgtagctggtctgagaggatgatcagccacactgggactgagacacggcccagactcctacgggaggcagcagtggggaatattggacaatgggcgcaagcctgatccagccatgccgcgtgtgtgaagaaggccttcgggttgtaaagcactttcagttgggaggaaggcctgtaagctaataccttgcaggattgacgttaccaacagaag

SEQ ID NO: 4365 - DNA, 490 bp, Unknown
  Ascusbbf_549953, encodes 16S rRNA
agagtttgatcctggctcaggacgaacgctggcggcgcgcctaacacatgcaagtcgaacggagttgcgacgacagatcccttcggggtgacgttatcgtaacttagtggcgaacgggtgagtaacacgtgagtaacctgcctttcagagggggacaacagttggaaacgactgctaataccgcataagaccacagtacggcatcgtacaggggtcaaaggagcaatccgctgaaagatggactcgcgtccaattagctggttggtgaggtaacggcccaccaaggcgacgattggtagccggactgagaggttgaacggccacattgggactgagacacggcccagactcctacgggaggcagcagtggggaatattgcacaatggaggaaactctgatgcagcgacgccgcgtgagggaagaaggtcttcggattgtaaacctctgtcttcagggacgataatgacggtacctgaggaggaagccacg

SEQ ID NO: 4366 - DNA, 490 bp, Unknown
  Ascusbbf_135829, encodes 16S rRNA
agagtttgatcctggctcagattgaacgctggcggcatgctttacacatgcaagtcgaacggcagcacgggtgcttgcacctggtggcgagtggcgaacgggtgagtaatgcatcggaacgtacctatcagtgggggataacacatcgaaagatgtgctaataccgcatattatccgaggatgaaagcgggggaccttagggcctcgcgctgatagagcggccgatgtcggattagctagttggtgaggtaaaggctcaccaaggcgacgatccgtagcgggtctgagaggatgatccgccacactgggactgagacacggcccagactcctacgggaggcagcagtggggaattttggacaatgggcgaaagcctgatccagccatgccgcgtgagtgaagaaggccttcgggttgtaaagctcttttgtccgggaggaaatcctgacccctaatacgggtcggggatgacagtactggaagaataagc

SEQ ID NO: 4367 - DNA, 490 bp, Unknown
  Ascusbbf_722558, encodes 16S rRNA
agagtttgatcctggctcagaatgaacgctggcggcatggattaggcatgcaagtcgaacgagaaagcgtcttcgggcgcgagtaaagtggcgaaagggtgagtaacacgtgaggaacctgccccccagtccggaacaatcctgtgaaaacgggcctgaaaccggatgccggcccactccgcatggagtggagccgaaacatttatggctggaggatggcctcgcgtcccattagcttgttggcggggtatcggcccaccaaggctacgacgggtaggtggtctgagaggatggtcacccacactgggactgagacactgcccagactcctacgggaggctgcagtcgagaatcttccgcaatgggcgcaagcctgacggagcgatgccgcgtgagggaagtaggccttcgggtcgtgaacctctgtcgacggggacgaacgcaatgacggtacccgtcaagaaagccacggctaaccacgtgccagcag

SEQ ID NO: 4368 - DNA, 490 bp, Unknown
  Ascusbbf_75597, encodes 16S rRNA
agagtttgatcatggctcaggacgaacgctggcggcgtgcctaacacatgcaagtcgaacgaacgaggtagcaatactgagttagtggcggacgggtgagtaatgcatgagcaacctacctcatacagggggatagcacttagaaatgagtggtaataccgcataataaccatacatggcatcatgtaaggaggaaaggaggaatccggtaagagatgggctcatgttcgattagctagttggtgaggtaaaggcttaccaaggcgacgatcgatagccgaactgagaggttgaacggccacattggaactgagatacggtccagactcctacgggaggcagcagtgggggatattgcgcaatggggggaaccctgacgcagcaacgccgtgtgaaggaagaaggctttcgggttgtaaacttctttgattagggacgaaagagatgacggtacctaaggaacaagccacggctaactacgtgccagcag

SEQ ID NO: 4369 - DNA, 490 bp, Unknown
  Ascusbbf_430932, encodes 16S rRNA
agagtttgatcatggctcaggatgaacgctggcggcgtgcctaacacatgcaagtcgaacgaagcactggtgcggaagccctcgggtggaagcacctctgactgagtggcggacgggtgagtaacgcgtgggaaacctgccctatacagggggataacggcgggaaactgctgttaataccgcataagcgcacaagggccgcatggcccggtgtgaaaagctccggtggtataggatggtcccgcgtctgattagctggttggcggggtaacggcccaccaaggcgacgatcagtagccggcctgagagggcgaccggccacattgggactgagacacggcccagactcctacgggaggcagcagtggggaatattgcacaatgggggaaaccctgatgcagcgacgccgcgtgagtgacgaagtatctcggtatgtaaagctctatcggcaggggagaaattgacggtacctgactaagaagccccggc

SEQ ID NO: 4370 - DNA, 490 bp, Unknown
  Ascusbbf_1565747, encodes 16S rRNA
agagtttgatcatggctcaggacgaacgctggcggcgtgcctaacacatgcaagtcgaacggaagttagagcttcggttttaactttagtggcgaacgggtgagtaacgcgtgaagaacctgcctttcagtgggggacaacagttggaaacgactgctaataccgcatgaaacttcgagagggcatcctcttgaagtcaaagctttatgtgctgaaagatggcttcgcgtctgattagctagttggtggggtaacggcccaccaaggcgacgatcagtagccggtctgagaggatgaacggccacattgggactgagatacggcccagactcctacgggaggcagcagtggggaatattgggcaatgggggaaaccctgacccagcaacgccgcgtgaaggaagaaggccttcgggttgtaaacttcttttagcagggacgaaggacgtgacggtacctgcagaaaaagcaacggctaactacgtgccag

SEQ ID NO: 4371 - DNA, 490 bp, Unknown
  Ascusbbf_649620, encodes 16S rRNA
agagtttgatcatggctcaggacgaacgctggcggcatgcttaacacatgcaagtcgaacgggttaaatttgctatagcgatataggagatttaatttagtggcgaacgggtgagtaacgcgtgagcaacctgccgtacacactgggataacagagggaaacttctgctaataccggatatgaccacgaaggggcatccctttggggtgaaagtgctttagcggtgtacgatgggctcgcgtcctattaggtagttggtgagataacagcccaccaagccgatgataggtagccgacttgagagagtgatcggccacaatggaactgagacacggtccatactcctacgggaggcagcagtggggaatattgggcaatgggcgcaagccttacccagcaatgccgcgtgaatgattgaaggtcttcggattgtaaagttcttttattggtgacgaaatctgacggtagccgatgaataagccccggctaa

SEQ ID NO: 4372 - DNA, 490 bp, Unknown
  Ascusbbf_1512747, encodes 16S rRNA
agagtttgatcatggctcagattgaacgctggcggcgtgcctaacacatgcaagtcgagcggtaacaggtgtagcaatacatgctgacgagcggcggacgggtgagtaacgcttgggaatctgcctatcagtgggggacaacccggggaaactcgggctaataccgcatacgatctacggatgaaagccggggaccgcaaggcctggcgctgatagatgagcccaagtcggattagctagttggtagggtaatggcctaccaaggcgacgatccgtaactggtctgagaggacgaccagtcaaaccggaactgagacacggtccggactcctacgggaggcagcagtggggaatattggacaatgggggcaaccctgatccagcgacgccgcgtgggtgaagaaggcctgcgggttgtaaagccctttcggttgggaagaaaagttgcgacctaacacgttgtgaccttgacgtaaccaactaaagaagc

SEQ ID NO: 4373 - DNA, 490 bp, Unknown
  Ascusbbf_280400, encodes 16S rRNA
agagtttgatcatggctcaggatgaacgctggcggcatgcctaagacatgcaagtcgaacgaagaagcccaatgaagattgagtgcttgcacgagattggaactggatacttcttagtggcagacgggtgagtaacacgtgggtaatctacctcagagactgggataacgtttggaaacgaacgctaataccggataaatcatatttggataaccagatatgctaaaaggagctacggcttcgctttgagatgagcttgcggtgtattagctagttggtgaggtaatggctcaccaaggcaacgatgcatatccgagctgagaggctgatcggacacactgggactgagacacggcccagactcctacgggagacagcagttaggaatattcgtcaatggaggaaactctgaacgagcaatgccgcgtgagtgatgaaggtcttacagattgtaaaactctgttgtaaaggaagaaatcttattataggg

SEQ ID NO: 4374 - DNA, 242 bp, Unknown
  Ascusbbf_1734912, encodes 16S rRNA
agagtttgatcatggctcaggacgaacgctggcggtatgcttaacacatgcaagtcgaacgagaagcttcttaatgatccttcgggagatttaagaagtggatagtggcgaacgggtgagtaacgcgtgggcaacctgcctttcggagcggaatagcctcgggaaaccgggagtaaagccgcataacattattttttcgcatgaagaaataatcaaaactccgtgccagcagccgcggtaat

SEQ ID NO: 4375 - DNA, 490 bp, Unknown
  Ascusbbf_660999, encodes 16S rRNA
agagtttgatcatggctcagaacgaacgctggcagcgtggattaggcatgcaagtcgaacgggatcgcttggatagcaatattcgggcgtgagagtggcggattggggaggagcacgtgagcaacctgccctggagatgtggaaaacctctggaaacggaggctaatacagaatgtggcgccccatggcatcatgggagcgccgaagggggccgcaaggctcccgctccgggatgggctcgcgcaccatcagctagttggcggggtaacggcccaccaaggcctacggttagctggtctgagaggatgaccagccccactgggactgagatactgcccagactcctacgggaggctgcagtcgaggatcattcgcaatggacggaagtctgacgatgcgacgctgcgtggaggatgaaggccttcgggtcgtaaactcctgtcatgagggaagaggcgagggaagctaataccttctttagttgactgta

SEQ ID NO: 4376 - DNA, 488 bp, Unknown
  Ascusbbf_499009, encodes 16S rRNA
agagtttgatcatggctcagaacgaacgctggcggcaggcttaacacatgcaagttgaacgggattattgagtagcttgctatttgatatgagggtggcgcacgggtgagtaatacgtgggaacatacctagtagttcggaacaactgatggaaacgtcagctaataccggataagccctgagggggaaagatatatcgctattagaatggcccgcggcagattaggcagttggtggggtaaaggcctaccaaacctacgatctgtagctgatctgagaggacgatcagccacattggaactgagacacggtccggactcctacgggaggcagcagtgaggaatattgggcaatggaggaaactctgacccagccatgccgcgtgagtgaagaaggttttcggattgtaaagctctttcgggagagaagatgatgacggtatctccagaagaagccccggcaaacttcgtgccagcagccgcggtaat

SEQ ID NO: 4377 - DNA, 490 bp, Unknown
  Ascusbbf_427457, encodes 16S rRNA
agagtttgatcatggctcaggatgaacgctagcggcaggcttaacacatgcaagtcgaggggcatcgcgggtagcaatacctggcggcgaccggcgaaagggtgagtaacgcgtgagcaacgtgcccgtggttgggggatagtcgatggaaacgtcgcgtaataccccgtaacacatggaatcgcatggttctatgttgaaagattcattgaccacggatcggctcgcgtgccattaggtagacggcggggtaacggcccaccgtgccgacgatggctaggggttctgagaggaaggtcccccacattggaactgagacacggtccagactcctacgggaggcagcagtgaggaatattggacaatggccggaaggctgatccagccatgccgcgtgcgggaggacggccctatgggttgtaaaccgcttttgcgagggagcaataagggtcacgagtggcccgatgagagtaccttacgaataagcatc

SEQ ID NO: 4378 - DNA, 490 bp, Unknown
  Ascusbbf_1484314, encodes 16S rRNA
agagtttgatcatggctcaggacgaacgctggcggcgtgcctaacacatgcaagtcgaacggagttattgtgaatgaagatttcggttggattttacagtgacttagtggcggacgggtgagtaacgcgtgagtaacctgccgataagagggggataacgttttgaaaagaacgctaataccgcataatgtatttgaatcgcatggtttgaataccaaaggagcaatccgcttatcgatggactcgcgtccgattagctagttggcggggtaaaggcccaccaaggcgacgatcggtagccggactgagaggttgaacggccacattgggactgagacacggcccagactcctacgggaggcagcagtgggggatattgcgcaatgggggaaaccctgacgcagcaacgccgcgtgaaggacgaaggtcttcggattgtaaacttcttttgttaaggacgaagaaagtgacggtacttaacgaataagct

SEQ ID NO: 4379 - DNA, 490 bp, Unknown
  Ascusbbf_1489769, encodes 16S rRNA
agagtttgatcatggctcaggatgaacgctggcggcgtgcgtaacacatgcaagttgagcgacgcaaacatggaagcagagatgtggaagtgtttaacggagcggcggacgggtgagtaagacatgagaagctgtccaacagagggggacaacgtctggaaacggacgctaataccccgtaggccgggaggttaaagcagagatgtgctgttggaggtgctcgtgacctatcagctagttggtgaggtaactgctctaccaaggcgacgacgggtagccggcctgagagggtgaacggccacactgggactgagatacggcccagactcctacgggaggcagcagtggggaatattgggcaatgggggagaccctgacccagcgacgccgcgtgaacgaagacggctttagggttgtaaagttcttttatgcgggaagaaggaagtgacggtaccgcatgaataagccccggctaactacgtgccagcag

SEQ ID NO: 4380 - DNA, 490 bp, Unknown
  Ascusbbf_928205, encodes 16S rRNA
agagtttgatcatggctcagagtgaacgctggcggcgtggttaagacatgcaggtcgagcgggatttatcatcatgagtcttcggatgaatgaggatgatgagagcggcaaacgggtgcgtaacacgtaaacaacttgccctttggtccggaatagctcaccgaaaggtggattaatgccggatgtggttccctttcgcatgaaagagatactaaagcttgtaacggcgctaaaggagaggtttgcgtcctatcagcttgatggtgaggtaaaggcttaccatggctaagacgggtagctggtctgagaggatgatcagccacagtggaactgagatacggtccacacacctacgggtggcagcagtttcgagtcattcacaatgggcgaaagcctgatggtgcaacgccgcgtgggggatgaaggttctcgaatcgtaaacccctgtcgccgaggaacaaaatccgggttcgtagcccggcttgagtta

SEQ ID NO: 4381 - DNA, 468 bp, Unknown
  Ascusbbf_1787376, encodes 16S rRNA
agagtttgatcatggctcagaacgaacgctggcggcaggcttaacacatgcaagtcgagcgccccgcaaggggagcggcagacgggtgagtaacgcgtgggaatctacccagtggtacgggacaacccagggaaacttggactaataccgtataagtccttcgggagaaagatttatcgccattggatgagcccgcgtcggattagctagttggtggggtaacggcctaccaaggcgacgatccgtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctcttttggcggggacgataatgacggtacccgcagaataagccccggctaacttcgtgccagcagccgcggtaat

SEQ ID NO: 4382 - DNA, 490 bp, Unknown
  Ascusbbf_1709648, encodes 16S rRNA
agagtttgatcctggctcaggacgaacgctggcggcgtgcctaatacatgcaagtcgagcggagtggatcgggagcttgctcctgatccacttagcggcggacgggtgagtaacacgtaggcaacctgcctgcaagactgggataactaccggaaacggtagctaataccggatacgcaagagagtcgcatgactttcttgggaaagacggagcaatctgtcacttgtggatgggcctgcggcgcattagctagttggtgaggtaacggctcaccaaggcgacgatgcgtagccgacctgagagggtgaacggccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtcgggtagagtaactgctacccgagtgacggta

SEQ ID NO: 4383 - DNA, 490 bp, Unknown
  Ascusbbf_461054, encodes 16S rRNA
agagtttgatcatggctcagaatgaacgttggcggcgtggattaggcatgcaagtcgtgcgataagcgtagcaatacgtggaaagcggcgaaagggagagtaatacgtgggtatctacctcggggcctgggatagcggcgggaaactgccggtaataccagatgatgtctccggaccaaaggtgtgattccgctctaagaggagcccacgtgctattagctagttggcagggtaacggcctaccaaggcaaagatggctatggggtgtgagagcatgcccccactcactgggactgagacactgcccagacacctacgggtggctgcagtcgagaatcttcggcaatgggcgaaagcctgaccgagcgacgccgcgtgcgggatgaaggccttcgggttgtaaaccgctgtcgtaggggaggaaggttttgcgaagagcaaaacttgaccgatcctaggaggaagggccggctaatctcgtgccagcagc

SEQ ID NO: 4384 - DNA, 487 bp, Unknown
  Ascusbbf_1805794, encodes 16S rRNA
agagtttgatcctggctcagaatgaacgttggcggcatggattaggcatgcaagtcgagcgagaaccgaggaagcttgcttctaaggggacagcggcgaaagggagagtaacaggtggatacctacctccaggctgggaatagcgtcgggaaactggcggtaatgcccaataacatctacggatcaaagctccggcgcctggagatgggtctgctcactattagctagttggtaaggtaatggcttaccaaggcgacgatggttagcgggcgtgagagcgtggcccgtctcactgggactgagacactgcccagacacctacgggtggctgcagtcgagaatcttcggcaatggacgcaagtctgaccgagcgatgccgcgtgcgggatgaaggccttcgggttgcaaaccgctgtcagagggaaggaaattttgaccaaacctcagaggaaggtcgggctaagttcgtgccagcagccgcggtaat

SEQ ID NO: 4385 - DNA, 489 bp, Unknown
  Ascusbbf_514431, encodes 16S rRNA
agagtttgatcatggctcagaatgaacgctggcggcatggattaggcatgcaagtcgaacgggatccttcggggtccagtggcggaagggtgagtaacacgtgagcaacccgcccccaaggccggaacaagcgctggaaacggcgtctgaaaccggatgaggacccccaccgcatggaggggcgtccaaatattcataccctggggatgggctcgcggcccattagcttgtcggcggggcgacggcccaccgaggcgacgacgggtaggtggtctgagaggatggtcacccacactgggactgagacactgcccagactcctacgggaggcagcagtgggggatattgcgcaatgggggcaaccctgacgcagcaacgccgcgtgaaggatgaaggttttcggattgtaaacttcttttgttagggacgaaaattgacggtacctaacgaataagctccggctaactacgtgccagcagccgcggtaat

SEQ ID NO: 4386 - DNA, 490 bp, Unknown
  Ascusbbf_891157, encodes 16S rRNA
agagtttgatcctggctcaggatgaacgctagcggcaggcttaacacatgcaagtcgaggggcatcagggggagcaatccccgctggcgaccggcggatgggtgcgtaacgcgtatgcaacctgcccgtaaccggaggataacccgccgaaaggcggactaaaaatccataagaccccgctgcggcatcgcagcgtggtaaaatctgcggaggttgcggatgggcatgcgtgccattaggtagttggtgaggcaacggctcaccaagcctacgatggctagggggtctgagaggatggtcccccacactggaactgagacacggtccagactcctacgggaggcagcagtgaggaatattggtcaatgggcggaagcctgaaccagccatgccgcgtgcaggaagacggccctatgggttgtaaactgcttttgcagaggagtaaagtggcgtacgtgtacgcctttgcaagtactttgcgaataagcat

SEQ ID NO: 4387 - DNA, 490 bp, Unknown
  Ascusbbf_1314219, encodes 16S rRNA
agagtttgatcatggctcaggatgaacgctagctacaggcttaacacatgcaagtcgaggggtaacgagtgggaagcttgcttcccacgtcgacgaccggcgcacgggtgagtaacgcgtatccaacctgccacatactcggggatagcccggtgaaaaccgaattaatacccgatggcgtcctttgcggacatccaacgaggactaaagatttacggtatgtgatggggatgcgtctgattagcttgttggcggggtaacggcccaccaaggcgacgatcagtaggggttctgagaggaaggtcccccacattggtactgagacacggaccaaactcctacgggaggcagcagtgaggaatattgatcaatgggcgagagcctgaaccagccaagtagcgtgcaggatgacggccctacgggttgtaaactgcttttataagggaacaaagtgaggcacgcgtgcctttttgcgtgtaccttatgaata

SEQ ID NO: 4388 - DNA, 490 bp, Unknown
  Ascusbbf_1567278, encodes 16S rRNA
agagtttgatcatggctcaggacgaacgctggcggcgtgcttaacacatgcaagtcgaacggagatttttatttcggtaaaaatcttagtggcaaacgggtgagtaacgcgtaggcaacctgcctttccgatggggacaacagttcgaaaggactgctaataccgaatgatgtatatcttccgcatggaggacataccaaagacggcctctatatataagctgtcacggaaagatgggcctgcgtctgattagccagttggcggggtaatggcccaccaaagcgacgatcagtagccggtctgagaggatgaacggccacattgggactgagacacggcccaaactcctacgggaggcagcagtggggaatcttccgcaatggacgaaagtctgacggagcaacgccgcgtgagtgaagaaggttttcgaatcgtaaagctctgttgtcagggacgagcagggggagtatcaacaacactctctcatgac

SEQ ID NO: 4389 - DNA, 472 bp, Unknown
  Ascusbbf_661867, encodes 16S rRNA
agagtttgatcatggctcagaacgaacgctggcggcaggcttaacacatgcaagtcgaacgggcatagcaatatgtcagtggcagacgggtgagtaacgcgtgggaacgtaccctttactacggaataacgcatggaaacgtgtgctaataccgtatgtgcccttcggggaaaagatttatcggtaaaggatcggcccgcgttggattagctagttagtggggtaaaggcctaccaaggcgacgatccatagctggtctgagaggatgatcagccacattgggactgagacacggcccaaactcctacgggaggcagcagtggagaatattggacaatgggcgcaagcctgatccagccatgccgcgtgagtgatgaaggccccagggttgtaaagctctttcaccggtgaagataatgactgtagccggagaagaagccccggctaacttcgtgccagcagccgcggtaat

SEQ ID NO: 4390 - DNA, 490 bp, Unknown
  Ascusbbf_472837, encodes 16S rRNA
agagtttgatcatggctcaggacgaacgctggcggcatgcctaacacatgcaagtcgaacggagcttaagaggcttgccttttaagcttagtggcggacgggtgagtaacgcgtgagcaacctgcctctcagtggggaataatgtactgaaaaggacactaataccgcatgatgtatttgagtcgcatgatttgaataccaaagatttatcgctgagagatgggctcgcgtccgattagtttgttggtgaggtaacggctcaccaaggcgacgatcggtagccggactgagaggttgaacggccacattgggactgagacacggcccagactcctacgggaggcagcagtgggggatattgcgcaatgggggaaaccctgacgcagcaatgccgcgtggaggattgaaggtcttcggattgtaaactccttttgtcagggaagataatgacggtacctgacgaataagctccggctaactacgtgccagc

SEQ ID NO: 4391 - DNA, 470 bp, Unknown
  Ascusbbf_225049, encodes 16S rRNA
agagtttgatcatggctcagaacgaacgctggcggcaggcttaacacatgcaagtcgaacgcccctttcggggggagtggcagacgggtgagtaacgcgtgggaacctacccaaaggtacggaataactcggggaaactcgtgctaataccgtatacgcccttcgggggaaagatttatcgcctttggatgggcccgcgtcggattagctagttggtgaggtaaaagctcaccaaggcgacgatccgtagctggtctgagaggatgatcagccacactgggactgagacacggcccagactcctacgggaggcagcagtggggaatattggacaatgggcgaaagcctgatccagccatgccgcgtgagtgaagaaggccttagggttgtaaagctctttcagcggggaagataatgacggtacccgcagaagaagccccggctaactccgtgccagcagccgcggtaat

SEQ ID NO: 4392 - DNA, 490 bp, Unknown
  Ascusbbf_1519971, encodes 16S rRNA
agagtttgatcctggctcagattgaacgctggcggcaggcctaacacatgcaagtcgggcggtaacaggaaagagcttgctcttttgctgacgagcggcggacgggtgagtaatgtatggggatctgcctgatggagggggataactactggaaacggtagctaataccgcataacgtcgcaagaccaaagagggggaccttcgggcctcttgccatcggatgaacccatatgggattagctggcaggtggggtaatggcctacctgggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcggggaggaaggcagtaaggttaataaccttgctgattgacgttacccgcagaag

SEQ ID NO: 4393 - DNA, 490 bp, Unknown
  Ascusbbf_1835850, encodes 16S rRNA
agagtttgatcatggctcagattgaacgctggcggcaggcttaacacatgcaagtcgaacggtagcacaggggagcttgctccctgggtgacgagtggcggacgggtgagtaatgcttgggaatctggcttatggagggggataactacgggaaactgtagctaataccgcgtaatgtctatggactaaagggtgggactttcgggccacctgccataagatgagcccaagtgggattaggtagttggtggggtaaaggcctaccaagccgtcgatctctagctggtctgagaggatgaccagccacactggaactgagacacggtccagactcctacgggaggcagcagtgaggaatattgcacaatggggggaaccctgatgcagccatgccgcgtgaatgaagaaggccttcgggttgtaaagttctttcggtgatgaggaaggggtgtaatttaataggttacatcattgacgttaatcacagaag

SEQ ID NO: 4394 - DNA, 490 bp, Unknown
  Ascusbbf_1480475, encodes 16S rRNA
agagtttgatcctggctcagaacgaacgctggcggcaggcctaacacatgcaagtcgagcgtgaaagggggcttcggctcccgagtaaagcggcgcacgggtgagtaacacgtgaataatctgccctcatgaccgggataacagatcgaaaggactgctaataccggataagctcacacgccaaccgggcgggtgggaaaagtgcgggaccttcgggccgcgcgcgtgaggatgagttcgcgtcccattagatagttggtgaggtaatggctcaccaagtcgacgatgggtagctggtctaagaggatgatcagccacactggaactgagacacggtccagactcctacgggaggcagcagtggggaatcttgcgcaatggaggaaactctgacgcagccatgccgcgtgagtgatgaaggccctcgggttgtaaagctctgtctaaggggacgaacgctcccgcgaacaagagacgcgtgaattgacgg

SEQ ID NO: 4395 - DNA, 490 bp, Unknown
  Ascusbbf_1454880, encodes 16S rRNA
agagtttgatcatggctcagaatgaacgttggcggcgtggattaggcatgcaagtcgcgcgacaagttcccttcggggaacggaggagcggcgaaagggagagtaacaggtagatatgtgcccttgggaccgggatagcgtcgggaaactggcggtaataccggataacatctccggatcaaatggtgtgattccgcccaaggatcagtctgcttcctattagcttgttggcggggtaatggcccaccaaggctgagatgggtaccgggtgtgagagcatgacccggctcactgggactgagacactgcccagacacctacgggtggctgcagtcgagaatctttggcaatgggcgaaagcctgaccaagcgacgccgcgtgcgggatgaaggccctcgggttgtaaaccgctgtcagttgggaggaagtgcatgagggttatcccttatgcttgaccgatcttcagaggaagtacgggctaagttcgtg

SEQ ID NO: 4396 - DNA, 472 bp, Unknown
  Ascusbbf_1651333, encodes 16S rRNA
agagtttgatcatggctcagaacgaacgctggcggcaggcttaacacatgcaagtcgaacgggcgtagcaatacgtcagtggcgcacgggtgagtaacgcgtggatatctgccttttggttcgggataaccttgggaaactagggctaataccgaatggttcctacgggataaagatttatcgccaaaagatgagtccgcgtccgattagcttgttggcggggtagcggcccaccaaggcgacgatcggtagctggtctgagaggacgatcagccacactgggactgagacacggcccagactcctacgggaggcagcagtggggaatattggacaatgggggcaaccctaatccagccatgccgcgtgagtgatgaaggccttcgggttgtaaagctcttttggcggggacgatgatgacggtacccgcagaataagccccggctaacttcgtgccagcagccgcggtaat

SEQ ID NO: 4397 - DNA, 490 bp, Unknown
  Ascusbbf_1646504, encodes 16S rRNA
agagtttgatcatggctcggattgaacgctggcggcaggcctaatacatgcaagtcgaacggtaacataagaaaagcttgcttttcttgatgacgagtggcggacgggtgagtaacatttgggaaactacctgatagagggggacaacagttggaaacgactgctaataccgcatacagcctaagggtgaaagaagcaattcgctatcagatgtgcccaaacgggattagctagtaggtgaggtaaaggctcacctaggcgacgatagttacccggcctaagagggtgatcgggcacattgggactgagatacggccagactcctacgggaggcagcggctaagaatattccgcaatggacgaaagtctgacggagcgacgccgcgtggatgatgaaggccggaaggttgtaaaatccttttatgactgaggaataaggaaagtgagagaaacgctttctggtgactgtaggtcatgaataagcaacggc

SEQ ID NO: 4398 - DNA, 490 bp, Unknown
  Ascusbbf_751034, encodes 16S rRNA
agagtttgatcctggctcaggatgaacgctagctacaggcttaacacatgcaagtcgaggggcagcatggagtcagcttgctgactctgatggcgaccggcgcacgggtgcgtaacgcgtatccaaccttcccgcgagtcagggacagcccggcgaaagtcggattaatacctgatgttctcctttgacggcatctgatgaggagtaaagatttcatcgcttgcggatggggatgcgtaggattagctggtaggcggggtaacggcccacctaggcgacgatccttaggggttctgagaggaaggtcccccacactggtactgagacacggaccagactcctacgggaggcagcagtgaggaatattggtcaatgtgcgtaagcctgaaccagccaagtagcgtgcaggatgacggccctacgggttgtaaactgcttttatgcggggataacgtgcgccacgggtggtgtattgcaggtaccgcatgaa

SEQ ID NO: 4399 - DNA, 208 bp, Unknown
  Ascusbbf_169833, encodes 16S rRNA
agagtttgatcctggctcaggacaaacaaccagtaagaatgaacctaaagaaaacagtgcgtagaagatccagactaaagcctctccaaatccaagcaaacctgacttaagcttagaattaagaagaagaatgcacaaattacaatccagaagttccagttagttacttgtgcaaccttgttgacatactgccagcagccgcggtaat

SEQ ID NO: 4400 - DNA, 490 bp, Unknown
  Ascusbbf_372391, encodes 16S rRNA
agagtttgatcctggctcaggatgaacgctggcggcgtgcctaatacatgcaagtcgagcgaagcacttcggtgcttagcggcgaacgggtgagtaacacgtaggtaacatgaccatatgacgaggataacggttggaaacgactgctaagactggataggaatgactgaggcatctcagtaattttaaagggatctcgtaagggaaacgcgtatggagtgacctgcggcgcattagctagttggtgggatagaagcctaccaaggcgatgatgcgtagccggactgagaggttgaacggccacattgggactgagacacggcccagactcctacgggaggcagcagtagggaattttcggcaatggggggaaccctgaccgagcaacgccgcgtgaatgacgaagtacttcggtatgtaaagttcttttattagtgaagacaggccctttagggggagaagacggtagctaatgaataagccccggcta

SEQ ID NO: 4401 - DNA, 490 bp, Unknown
  Ascusbbf_867643, encodes 16S rRNA
agagtttgatcatggctcagaatgaacgttggcggcgtggattaggcatgcaagtcgcgcgacaagcccgctaatagcaatattagtgggtggaggagcggcgaaagggtgaggaacacgtggatatctaccctcaggctcgggatagtggcgggaaactgccagtaataccgaataacatctccggatcaaagctccggcacctgaggacgagtccgcgtcccattagctagttggcggggtaatggcccaccaaggcaaagatgggtagtgggcgtgagagcgcgacccaccacactgggactgagatactgcccagacacctacgggtggctgcagtcgagaatcttcggcaatgggcgaaagcctgaccgagcgacgccgcgtggaggatgaaggccttcgggttgtaaactcctgtcggaggggaagaaattttgactaccccctcggaggaagcccgggctaagttcgtgccagcagccgcggt

SEQ ID NO: 4402 - DNA, 490 bp, Unknown
  Ascusbbf_416472, encodes 16S rRNA
agagtttgatcctggctcaggatgaacgctggcggcatgcctaacacatgcaagtcgaacggagctattacggaagcttgcttttgttttagcttagtggcggacgggtgagtaacgcgtgaggaacctgcccttcagtggggaataacaccgagaaatcggtgctaataccgcataacgtcttgagatcgcatgttcttaagaccaaaggatttattcgctgaaggatggcctcgcgtccgattagttagttggtggggtaacggcctaccaagaccgcgatcggtagccgaactgagaggttgatcggccacattgggactgagacacggcccagactcctacgggaggcagcagtggggaatattgggcaatgggggaaaccctgacccagcaatgccgcgtgaaggacgaaggtcttcggattgtaaacttctttgattggggaagaataaatgacctacccaaagaacaagtcacggctaactac

SEQ ID NO: 4403 - DNA, 483 bp, Unknown
  Ascusbbf_636152, encodes 16S rRNA
agagtttgatcatggctcagagcgaacgctagcggcgggcttaacacatgcaagtcgagcgcttcacttcggtgaagagcggcggacgggtgagtaacacgtaggttacctgcccccgggtgagggataaccgagggaaacctcggctaataccactgttggtctacggatcaaaggcttcggccgcctggggatgggcctgcgtcccattatttaatcctagttggtggggtaatggcctaccaagggtacgatgggtagctggtctgagaggatgatcagccacactggaactgagacacggtccagactcctacgggaggcagcagtggggaatattgcgcaatgggcgaaagcctgacgcagccacgccgcgtgagtgatgaaggccccagggtcgtaaagctctgtcgggggggaagaaaatctgacggtaccccccaagaaagcaccggctaactccgtgccagcagccgcggtaat

SEQ ID NO: 4404 - DNA, 490 bp, Unknown
  Ascusbbf_569652, encodes 16S rRNA
agagtttgatcctggctcaggacgaacgctggcggcgtgcttaacacatgcaagtcgagcggacggaggaacttcggttccgaagttagcggcggacgggtgagtaacgcgtgaacaatctgtcccagacagggggataacacatcgaaagatgtgctaataccgcataagaccacggtgccgcatggcacaggggtaaaagaacggaatcggtttggggtgagttcgcgtctgattagctagttggtgaggtaacggcccaccaaggcgacgatcagtagccgatctgagaggatgaccggccacattggaactgagagacggtccaaactcctacgggaggcagcagtggggaatattgggcaatgggcgcaagcctgacccagcaacgccgcgtgagggaagaaggttttcggattgtaaacctctgtcctaagggaagaaaggaatgacggtaccttaggaggaagccccggctaactacgtgcca

SEQ ID NO: 4405 - DNA, 490 bp, Unknown
  Ascusbbf_1443186, encodes 16S rRNA
agagtttgatcatggctcaggacgaacgctggcggcgtgcctaacacatgcaagtcgaacggggttatctgacttcggttggataacctagtggcgaacgggtgagtaacgcgtgagcaacctgaccttcagagggggataacatttggaaacagatgctaataccgcataagaccacgacccggcatcgggatgaggtcaaaggagcaatccgctgaaggaggggctcgcgtcccattagatagttggtgaggtaacggcccaccaagtcgacgatgggtagccgagctgagaggctgatcggccacactggaactgagacacggtccagactcctacgggaggcagcagtggggaatattgggcaatggggggaaccctgacccagcaacgccgcgtgagggaagaaggccttcgggttgtaaacctctgtccttggtgacgaagtaagtgacggtagccaaggaggaagccccggctaactacgtgc

SEQ ID NO: 4406 - DNA, 490 bp, Unknown
  Ascusbbf_1760256, encodes 16S rRNA
agagtttgatcatggctcaggacgaacgctggcggcgcgcttaacacatgcaagtcgaacgggcgtcttcgggcgtcagtggcggacgggtgcgtaacacgtgagcaacctacctggagttgggggataacctcgggaaaccggggctaataccgcatgtgctctgttgcctggaggggtgatggaggaaaggggctttcgggccctgactcgagaggggctcgcggcgtatcagctagctggtgaggtaacggctcaccagggcgatgacgcgtagggggtctgagaggatggccccccacattgggactgagatacggcccagactcctacgggaggcagcagtggggaatcttgcgcaatggccgaaaggctgacgcagcgacgccgcgtgcgggaggaagcccttcggggtgtaaaccgctgtcagagggggcgaatgccatggggaggaaatgcctttcatggagggacggtaccctcagaggaa

SEQ ID NO: 4407 - DNA, 486 bp, Unknown
  Ascusbbf_683031, encodes 16S rRNA
agagtttgatcctggctcagaatgaacgttggcagcgtggattaggcatgcaagtcgagcgacaaggtgcttcggcactggaggagcggcaaacggggtagtaaggcatcggaacgtaccctcttgttcaggatacccgcgggaaactgcggttaatactggataatcccgaaagggcaaaggtccgccgcgggaggagcggccgatgtgatatcagctagttggtagggtaatggcctaccaaggcttagacgtctagggggtgtgagagcatggcccccaccactgggactgagatactgcccagacacttacgggtggctgcagtcgagaatcttcggcaatgggcgcaagcctgaccgagcgacgctgcgtgtgggatgaaggcccttgggttgtaaaccactgtcagaggggatgaaagcgtaagcttgacagagcctcagaggaagcgcgggctaagttcgtaccagcagccgcggtaat

SEQ ID NO: 4408 - DNA, 489 bp, Unknown
  Ascusbbf_194298, encodes 16S rRNA
agagtttgatcatggctcagcctgaacgctggcggcgtggctaagacatgcaagtcgcacgggcgtagcaatacgtcagtggcgaacgggtgagtaatgaatcgctaatgtaccctggactctgggatagctagccgaaaggctaggtaataccagatgagaccacggcaccgcatggtgttgtgctcaaaggtccgccggtctgggatcaggcgatttcgtatcagctagttggtagggtaatggcctaccaaggcgacgacgcgtagccggactgagaggttggccggccacatcgggactgagacactgcccggactcctacggggggctgcagtaacgaatcttccgcaatgcacgaaagtgtgacggagcgacgccgcgtgtaggatgaagtccttcgggatgtaaactactgtcaggggttagaaagttctgatcaaccccagaggaaggcacggctaactctgtgccagcagccgcggtaat

SEQ ID NO: 4409 - DNA, 490 bp, Unknown
  Ascusbbf_482297, encodes 16S rRNA
agagtttgatcctggctcaggatgaacgctggcggcgtgcctaacacatgtaagtcgagcggagttattcggaagcttgcttctgaataacttagcggcggacgggtgagtaacgcgtgagcaacctgcccttaacagaggaacaacagtgagaaatcgctgctaatgcctcataagctcccgctgccacatggcagagagagaaaagatttatcggttagggaggggctcgcgtctgattagctagttggtggggtaacggcctaccaaggcgacgatcagtagccgacctgagagggtgatcggccacattggaactgagacacggtccaaactcctacgggaggcagcagtggggaatattgcacaatgggggaaaccctgatgcagcaacgccgcgtgaaggaagaagtggttcgccacgtaaacttctatcaatagggaagaataaaattgacagtacctaaataagaagcaccggctaaatacg

SEQ ID NO: 4410 - DNA, 490 bp, Unknown
  Ascusbbf_1839275, encodes 16S rRNA
agagtttgatcctggctcagaatgaacgctggcgacgtggattaggcatgcaagtcgcgcgagatccgtagcaatacggtgaaagcggcgtaagggatagtaacacgtagatacgtaccctcgggtctggaatagctgcgggaaactgcaggtaatgccagataatgttttcgaaccaaaggtgagattccgcccgtggattggtctgcgtcctattagcttgttggtgaggtaatggctcaccaaggcaatgatgggtagcgggtgtgagagcacgacccgcatcactgggactgagacactgcccagacacctacgggtggctgcagtcgaggatcttcggcaatgggcgcaagccttaccgagcgacgtcgcgtgcgggatgaaggccttcgggttgtaaaccgctgtcagtggggaggaagtataggtgggtactcccatctatttgacctatccgcagaggaagtgtgggctaagttcgtgccag

SEQ ID NO: 4411 - DNA, 490 bp, Unknown
  Ascusbbf_765497, encodes 16S rRNA
agagtttgatcctggctccggacgaacgctggcggcgtgcttaacacatgcaagtcgaacgaggtccaaccgatcttcggattggtgacgacctagtggcgaacgggtgcgtaacacgtgaggaacctaccccagtctctggaataacaagcggaaacgtttgctaataccggatgtcgtcgctccatcacatgacggagcgacaaaagatttatcgggttgggagggtctcgcggcctatcagctagttggtgaggtaacggttcaccaaggcatcgacgggtagctggtctgagaggatgatcagccacactgggactgagacacggcccagactcctacgggaggcagcagtggggaatcttgcacaatgggcgaaagcctgatgcagcaacgccgcgtgcgggaagaaggccctagggttgtaaaccgctttcagcagggaagaaactgacggtacctgcagaagaaggtgcggccaactacgtgc

SEQ ID NO: 4412 - DNA, 490 bp, Unknown
  Ascusbbf_1220055, encodes 16S rRNA
agagtttgatcctggctcaggacgaacgctggcggcgtgcctaacacatgcaagtcgagcgagaagtcaataacagatttcttcggaatgaagtaattgatggaaagcggcggacgggtgagtaacgcgtgagtaacctgccttcaagagggggacaacagttggaaacgactgctaataccgcataacattgcgaaatcgcatgataacgcaatcaaagatttatcgcttgaagatggactcgcgtccgattagatagttggtgaggtaacggctcaccaagtcgacgatcggtagccgaactgagaggttgatcggccacattgggactgagacacggcccagactcctacgggaggcagcagtgggggatattgcgcaatgggggcaaccctgacgcagcaacgccgcgtgaaggaagaaggttttcggattgtaaacttctttaagtgtggaagaagatgacggtacacacagaataagccacggc

SEQ ID NO: 4413 - DNA, 470 bp, Unknown
  Ascusbbf_435849, encodes 16S rRNA
agagtttgatcatggctcagaacgaacgctggcggcaggcctaacacatgcaagtcgaacgctctcgcaagagggagtggcgcacgggtgagtaacacgtgggaatctacctgatagtacgggataacagttggaaacgactgctaataccgtatacgcccttagggggaaagatttatcgctatcagatgagcccgcgctagattagctagttggtgaggtaaaggctcaccaaggctccgatctatagccggtctgagaggacgatcggccacactgggactgagacacggcccagactcctacgggaggcagcagtggggaatattgggcaatggacgcaagtctgacccagccatgccgcgtgagtgatgaaggccttagggttgtaaagctctttcagtagtgaagataatgactgtaactacagaagaagccccggctaattccgtgccagcagccgcggtaat

SEQ ID NO: 4414 - DNA, 472 bp, Unknown
  Ascusbbf_589819, encodes 16S rRNA
agagtttgatcatggctcagaacgaacgctggcggcaggcctaacacatgcaagtcgaacgggcgtagcaatacgtcagtggcagacgggtgagtaacacgtgggaacctacccggtggtacggaataactcagggaaacttgagctaataccgaatacgcccttagggggaaagatttatcgccatcggaagggcccgcgtcggattagtttgttggtggggtaatggcctaccaagactacgatccgtagctggtctgagaggatgaccagccacactgggactgagacacggcccagactcctacgggaggcagcagtggggaatcttggacaatgggcgcaagcctgacccagccatgccgcgtgagtgaagaaggccctagggttgtaaagctctttcggcggggacgataatgacggtacccgcagaagaagccccggctaactccgtgccagcagccgcggtaat

SEQ ID NO: 4415 - DNA, 490 bp, Unknown
  Ascusbbf_1571614, encodes 16S rRNA
agagtttgatcatggctcaggatgaacgctggcggcgtgcttaacacatgcaagtcgagcgagaaatcgctcagccaactcttcggatgaagcagagcgatggaaagcggcggacgggtgagtaacgcgtgggaaacctgcccctggcagggggacagccgagggaaacttcgattaataccccataaagcagggaaatcgcatgatgatcttgccaaagatttatcggccagggatggtcccgcgtctgattagctggttggtgaggtagcggctcaccaaggcgacgatcagtagccggcctgagagggtgaacggccacattggaactgagacacggtccagactcctacgggaggcagcagtggggaatattgcacaatgggagaaaccctgatgcagcaacgccgcgtgaaggaagaaggccttcgggtcgtaaacttctgtccttggggaagaagaatgacggtacccttggaggaagccccgg

SEQ ID NO: 4416 - DNA, 490 bp, Unknown
  Ascusbbf_1898594, encodes 16S rRNA
agagtttgatcatggctcagaatgaacgctggcggcgtgcctaacacatgcaagtcgagcgagaaagctccttcgggagtaagtacagcggcggacgggtgagtaacacgtgagaatctaccctttagtgaagaatacccttgggaaatcaaggttaatgctgcatatgtcccttcggggagaaagatggcctctttgctgtcgctaaaggatgagcttgcggactattagctagttggtgaggtaatggctcaccaaggcgatgatggatagccggcctgagagggtgtacggccacactggaacttagacacggtccagactcctacgggaggcagcagtgaggaatattgcgcaatgggcgaaagcctgacgcagcgacgccgcgtggaggatgacggtcttcggaatgtaaactcctgcttaagtgggaagaaagactcgcttttaatagaagcgagggatgacggtaccattagagaaagcaccg

SEQ ID NO: 4417 - DNA, 172 bp, Unknown
  Ascusbbf_182261, encodes 16S rRNA
agagtttgatcctggctcagcggtaaaggaaacatcatcaagtaccggatgctctggatcatcagagaaatgaaaaccaacatgattgaaaacaactttgccttgaatctgcaatggctgttcattcggctcaacttcaatttcaggcttagttgccagcagccgcggtaat

SEQ ID NO: 4418 - DNA, 490 bp, Unknown
  Ascusbbf_586087, encodes 16S rRNA
agagtttgatcctggctcaggatgaacgctagctacaggcttaacacatgcaagtcgaggggcagcgggggagcagcaatgctcctgccggcgaccggcgcacgggtgcgtaacgcgtatccaacctgccgcgtactccgggacagccctctgaaaggaggattaataccggatgttgccggggccaggcatctggcccgggcgaaagattcatcggtacgccgatggggatgcgtctgattagcttgttggcggggtaacggcccaccaaggcgacgatcagtaggggttctgagaggaaggtcccccacataggaactgagacacggtcctaactcctacgggaggcagcagtgaggaatattggtcaatgggcggaagcctgaaccagccaagtagcgtgaaggaagactgccctacgggttgtaaacttcttttatccgggaataaagtgcgccacgcgtggcgttttgtatgtaccggatgaata

SEQ ID NO: 4419 - DNA, 487 bp, Unknown
  Ascusbbf_497328, encodes 16S rRNA
agagtttgatccttgctcagaacgaacgctggcggcaggcttaacacatgcaagtcgagcgcgcgctttcgggcgtgagcggcggacgggtgagtaacgcgtgggaacgtgccctttggttcggaatagccctgggaaaccgggagtaatgccgaataagctctccttgagtagatcttggggaggaaagatttatcgccgaaggatcggcccgcgttggattaggtagttggtggggtaacggcctaccaagccgacgatccatagctggtttgagaggatgaccagccacactgggactgagacacggcccagactcctacgggaggcagcagtggggaatcttggacaatgggggcaaccctgatccagccatgccgcgtgagcgatgaaggccttagggttgtaaagctctttcagcggggaagataatgacggtacccgcagaagaagccccggctaactccgtgccagcagccgcggtaat

SEQ ID NO: 4420 - DNA, 490 bp, Unknown
  Ascusbbf_1324557, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgacattagctagttggtaaggtaacggcttaccaaggcgacgatgtctaggggagctgagagacttatcccgcaccctgcaactgagccacggaccaacttccgacggagggaagcagtgaggaatattggtaaatggacggaagtctgaaccagccatgccgcgtggaggaagaaggtcctatgggttgtaaactccttttgttcgagagtaataagggctttgcgaagcccgatgagagtatcggacgaataagc

SEQ ID NO: 4421 - DNA, 490 bp, Unknown
  Ascusbbf_1220894, encodes 16S rRNA
agagtttgatcatggctcaggacgaacgctggcggcgtgcctaacacatgcaagtcgaacggggtccatgagagcttgctctcggacgacctagtggcgaacgggtgagtaacacgtgagaaacctgccttggagtggggaataactcggggaaactcgagctaataccgcataccttcctttgatagcatggtcagctgaagaaagaatttcgctccaagagggtctcgcggcctatcagcttgttggtggggtaacggcctaccaaggcaacgacgggtagctggtttgagagaacgatcagccacactggaactgagacacggtccagactcctacgggaggcagcagtggggaatcttgcgcaatgggcgaaagcctgacgcagcaacgccgcgtgcgggatgaaggccttcgtggttgtaaaccgctttcagcagggacgaaaatgacggtacctgcagaagaagccccggctaactacgtgcca

SEQ ID NO: 4422 - DNA, 488 bp, Unknown
  Ascusbbf_692272, encodes 16S rRNA
agagtttgatcctggctcagaacgaacgctggcggcatggattaggcatgcaagttgaacgaacccctcggggtgagtagcggaagggtgaggaacgcgtgagtaatctgcccccaagttgggaataacagctggaaacggctgctaataccgaatgtggctcttggttcgcatggaccttgggctaaaggtttactgcttggggatgagctcgcgtcccattaggtagttggtgaggtaacggctcaccaagccgacgatgggtagctggtctgagaggatggtcagccacactgggactgagacactgcccagactcctacgggaggctgcagtcgagaatcttgggcaatgcgcgaaagcgtgacccagcagtgccgcgtgtgtgatgaaggccctcgggtcgtaaaacactgtctcccgtgacgaaatttgacggtagcggggaaggaagccacggctaactacgtgccagcagccgcggtaat

SEQ ID NO: 4423 - DNA, 468 bp, Unknown
  Ascusbbf_595400, encodes 16S rRNA
agagtttgatcatggctcagaacgaacgctggcggcaggcctaaaacatgcaagtcgaacgaaccttcgggttagtggcgcacgggtgagtaacacgtgggaatatgcccttcactacggaacaacgtcgggaaactgacgctaataccgtataatgtctccggaccaaagatttatcggtgaaggattagcccgcgtctgattaggtagttggtgaggtaatggctcaccaagccgacgatcagtagctggtctgagaggatgatcagccacactggaactgagacacggtccagactcctacgggaggcagcagttaggaatattggacaatgggggaaaccctgatccagccatgccgcgtgtgtgaagaaggccttagggttgtaaagcactttcagctgtgaagataatgacagtagcagaagaagaagctccggctaaattcgtgccagcagccgcggtaat

SEQ ID NO: 4424 - DNA, 490 bp, Unknown
  Ascusbbf_1783768, encodes 16S rRNA
agagtttgatcctggctcagggtgaacgctggcggcgtgcctaatacatgcaagtcgaacgagagcgaccttcgggtcaatctagtggcgaacgggtgagtaacacgtaggtaacctaccttagagtttggaataacagttggaaacgactgctaataccgaataggtaataggaagacatcttccaattattaaagatcccctaaaggatcgctaaaagagggacctgcgctgcattagttagttggtaaggtaacggcttaccaagaccgtgatgcatagccggactgagaggttgaacggcaacactgggactgagacacggcccagactcctacgggaggcagcagtagggaatcttcggcaatggggggaaccctgaccgagcaacgccgcgtgaatgaagaagtacttcggtacgtaaaattcttttattagggaagaatgatatttgtaggaaatgacaaataagtgacggtacctaatgaat

SEQ ID NO: 4425 - DNA, 490 bp, Unknown
  Ascusbbf_292103, encodes 16S rRNA
agagtttgatcctggctcaggacgaacgctggcggcgtgcctaacacatgcaagtcgaacgagaaataatataatgatcccttcggggagaattggattatggacagtggcggacgggcgagtaacgcgtgagtaacctgcccataaggaagggatagcccttggaaacgaggagtaataccttatgacatacagataccgcatggtgactgtatcaaagatttatcgcttatggatggactcgcgtctgattagatagttggtgaggtaacggctcaccaagtcgacgatcagtagccgaactgagaggttgatcggccgcattgggactgagacacggcccagactcctacgggaggcagcagtgggggatattgcgcaatgggggaaaccctgacgcagcaacgccgcgtgcaggaagaaggtcttcggattgtaaactgttgtcgcaggggaagaagaaagtgacggtaccctgtgagaaagtcac

SEQ ID NO: 4426 - DNA, 490 bp, Unknown
  Ascusbbf_1243719, encodes 16S rRNA
agagtttgatcctggctcaggatgaacgctggcggcgtgcttaacacatgcaagtcgaacgaagcacttaatgaagcttgctttataaagtgactgagtggcggacgggtgagtaacgcgtgggtaacctgcctcacacagggggataacagttagaaatgactgctaataccgcataaaatagcagtatcgcatgatacaactatcaaagatttatcggtgtgagatggacccgcgtctgattagcttgttggtggggtaacggcctaccaaggcgacgatcagtagccgacctgagagggtgaccggcaacattgggactgagacacggcccaaactcctacgggaggcagcagtggggaatattggacaatgggcgcaagcctgatccagcgacgccgcgtgagcgatggagtatttcggtatgtaaagctctatcagcagggaagaaaacgacggtacctgactaagaagccccggctaactacgt

SEQ ID NO: 4427 - DNA, 490 bp, Unknown
  Ascusbbf_481010, encodes 16S rRNA
agagtttgatcctggctcaggatgaacgctagcggcaggcttaacacatgcaagtcgaggggcagcacgtcttcggatggtggcgaccggcgaacgggtgagtatcgcgtatgcaatctaccttttactggggcatagcccggggaaacccggattaatatcccatagtaccatttactggcatcagtttttggttaaagcttcggcggtaaaagatgagcatgcgtcctattagcttgatggtaaggtaacggcttaccatggctttgataggtaggggtcctgagagggagatcccccacactggtactgagacacggaccagactcctacgggaggcagcagtgaggaatattggacaatgggcgagagcctgatccagccatgccgcgtgcaggaagactgccctatgggttgtaaactgcttttatacgggaagaaacactccctcgtgagggagcttgacggtaccgtatgaataaggatcggc

SEQ ID NO: 4428 - DNA, 490 bp, Unknown
  Ascusbbf_1368512, encodes 16S rRNA
agagtttgatcctggctcagaatgaacgctggcggcatggattaggcatgcaagtcgaacgagaaagcggcctcggccgcgagtaaagtggcgaaagggtgagtatcacgtggggaacctgccccggggaccggaacaagcccgtgaaaacgggtctgagaccggatgaggccccgtcccgcatgggtcggaggcgaaacattcatggccccgggatggccccgcgccccattagctggttggcggggtgacggcccaccaaggctgcgacgggtaggtggtctgagaggatggtcacccacactgggactgagacactgcccagactcctacgggaggctgcagtcgagaatcttccgcaatgggcgcaagcctgacggagcgatgccgcgtgagggaaggaggccttcgggtcgtaaacctctgtcggccggaatgaagcagatgacggtaccggccaaggaagccacggctaaccacgtgccagcag

SEQ ID NO: 4429 - DNA, 490 bp, Unknown
  Ascusbbf_455113, encodes 16S rRNA
agagtttgatcatggctcaggatgaacgctggcggcgtgcttaacacatgcaagtcgagcggaagtattttaaagcttgctttttaatactttagcggcggacgggtgagtaacgtgtgggtaacctgccatatactggggaataatcatttgaaaagatgactaataccgcatgtggtcacgagaaggcatcttcttgtgaagaaaggacttcggttcggtatatgatggacccgcatctgattagctagttggtgagataacagctcaccaaggcaacgatcagtagccgacctgagagggtgatcggccacattgggactgagacacggcccaaactcctacgggaggcagcagtggggaatattgcacaatgggcgaaagcctgatgcagcaacgccgcgtgaaggaagaagggtttcggctcgtaaacttctatcaatggggaagaaataaatgacggtacccaaataagaagccccggctaact

SEQ ID NO: 4430 - DNA, 490 bp, Unknown
  Ascusbbf_1034442, encodes 16S rRNA
agagtttgatcatggctcagattgaacgctggcggcatgccttacacatgcaagtcgaacggtaacgcgggggcaaccctggcgacgagtggcgaacgggtgagtaatacatcggaacgtacccagtagtgggggatagctcggcgaaagccggattaataccgcatacgcactgtggtggaaagcgggggatcgcaagacctcgcgctattggagcggccgatgtcggattagcttgttggtggggtaagagcctaccaaggcgacgatccgtagctggtctgagaggacgaccagccacactgggactgagacacggcccagactcctacgggaggcagcagtggggaattttggacaatgggcgaaagcctgatccagcaatgccgcgtgtgtgaagaaggccttcgggttgtaaagcacttttgtccggaaagaaatctgtctggctaatacccggacgggatgacggtaccggaagaataagcac

SEQ ID NO: 4431 - DNA, 490 bp, Unknown
  Ascusbbf_1219721, encodes 16S rRNA
agagtttgatcctggctcagaacgaacgctggcggcaggcctaacacatgcaagtcgagcgcgaaagggacttcggtcccgagtaaagcggcgcacgggtgagtaacacgtgaataatctgcctttatgactgggataacagaccgaaaggactgctaataccggataagctcccgcgccaatcgggcgagtggagaaaagagtgggacccttcggggccacttccatagagatgagttcgcgtcccattagatagttggtgaggtaatggctcaccaagtcaacgatgggtagctggtcttagaggatgatcagccacactggaactgagacacggtccagactcctacgggaggcagcagtggggaatcttgcgcaatggaggaaactctgacgcagccatgccgcgtgagtgatgaaggccctcgggtcgtaaagctctgtctaaggggaagaacggtgcaaggtctaacaggctttgcaattgacg

SEQ ID NO: 4432 - DNA, 490 bp, Unknown
  Ascusbbf_1833504, encodes 16S rRNA
agagtttgatcatggctcaggatgaacgctagcggcaggcctaacacatgcaagtcgaggggtataaggagcttgctccttagagaccggcgcacgggtgcgtaacgcgtatgcaatctaccttatgcaggggaatagcccgaagaaatttggattaatgccccatggtatatagaaaaggcatcttttttatattaaagttgaggcggcataagatgagcatgcgtcccattagctagttggtatggtaacggcataccaaggctacgatgggtaggggtcctgagagggagatcccccacactggtactgagacacggaccagactcctacgggaggcagcagtgaggaatattggacaatggtcgggagactgatccagccatgccgcgtgcaggaagactgccctatgggttgtaaactgcttttgtacaagaagaataagaggtacgtgtaccttgatgacggtattgtacgaataagcaccggc

SEQ ID NO: 4433 - DNA, 490 bp, Unknown
  Ascusbbf_735996, encodes 16S rRNA
agagtttgatcatggctcaggatgaacgctggcggcgtgcctaatacatgcaagtcgaacggagcgagacgctgaactgagataagcttgcttaaggaagttcttgttaagcttagtggcggacgggtgagtaacacgtgagcaacctgcctttcagagggggacaacgactggaaacggtcgctaataccgcataacataccgaagcggcatcgcattggtatcaaaggagcaatccgctgaaagatgggctcgcgcctgattagatagttggtgaggtaacggctcaccaagtcgacgatcagtagccggactgagaggttgaacggccacattgggactgagatacggcccagactcctacgggaggcagcagtagggaatattgcacaatgggggaaaccctgatgcagcaacgccgcgtgaaggaagacggttttcggattgtaaacttcttttctttgtgaagaaacaaatgacggtagcaaag

SEQ ID NO: 4434 - DNA, 472 bp, Unknown
  Ascusbbf_1362992, encodes 16S rRNA
agagtttgatcctggctcagagcgaacgctggcggaatgcttaacacatgcaagtcgcacgggggcttcggctcgagtggcggacgggtgagtaacgcgtaggaacgtgtcttggggtgggggataacgctgggaaactagcgctaataccgcatatgggctgaggcccaaagccttcgggtgccttgagagcggcctgcgtccgattagctagttggtggggtaaaggcttaccaaggcttcgatcggtagctggtctgagaggacgatcagccacactgggactgagacacggcccagactcctacgggaggcagcagtggggaatattggacaatgggcggaagcctgatccagcaattccgcgtgggtgaagaaggtcttcggattgtaaagccctttcgacagggacgatgatgacggtacctgtagaagaagccccggctaacttcgtgccagcagccgcggtaat

SEQ ID NO: 4435 - DNA, 468 bp, Unknown
  Ascusbbf_1876354, encodes 16S rRNA
agagtttgatcctggctcagaacgaacgctggcggcaggcctaacacatgcaagtcgaacgctctagcaatagagagtggcagacgggtgagtaacgcgtgggaaccttcccagtggtgcggaatagctcagggaaacttggggtaataccgcatgagcccgaaaggggaaagatttatcgccattggatgggcccgcgtcggattagctagttggtgaggtaatggctcaccaaggcaacgatccgtagctggtttgagagaatgaccagccacactgggactgagacacggcccagactcctacgggaggcagcagtgggaatcttggacaatgggcgcaagcctgatccagccatgccgcgtgagtgacgaaggccttagggttgtaaagctcttttggcggggacgataatgacggtacccgcagaataagccccggctaacttcgtgccagcagccgcggtat

SEQ ID NO: 4436 - DNA, 490 bp, Unknown
  Ascusbbf_1679631, encodes 16S rRNA
agagtttgatcctggctcaggatgaacgctggcagcgtgcctaatacatgcaagtcgaacgaaagcacttgtgctttagtggcgaacgggtgagtaacacgtaggtaacctgcccttatgacgaggataacagttggaaacgactgctaagactggatagtagcgaacaaggcatcttgaacgctttaaataacctaagggttaacataaggaggggcctgcggtgcattagttagttggtgaggtaagagctcaccaagaccgtgatgcatagccggactgagaggttgaacggccacattgggactgagacacggcccaaactcctacgggaggcagcagtagggaattttcggcaatggaggaaactctgaccgagcaacgccgcgtgattgaagaagcacttcggtgcgtaaaaatcttttattggggaagaaagacatgtagagggaatgctacgtgagtgacggtacccattgaataagccccg

SEQ ID NO: 4437 - DNA, 490 bp, Unknown
  Ascusbbf_581455, encodes 16S rRNA
agagtttgatcctggctcaggatgaacgctagcggcaggcctaacacatgcaagtcgaggggtaagaagagcttgctcttcctagaccggcgtacgggtgcgtaacgcgtgtacaatctaccttatacagagggatagcccggagaaatctggattaatatctcatagtattatatataggcatctctatatgattaaagcgtaagcggtataagatgagtacgcgttctattagctagttggagtggtaacggcaccccaaggctacgatagataggggtcctgagagggagatcctccacactggtactgagacagggaccagactcctacgggaggcagcagtgaggaatattggtcaatggtcggaagactgaaccagccatgccgcgtgcaggaagacggccttatgggttgtaaactgcttttgtatgggaagaataagctctacgcgtagagtgatgacggtactatacgaataagcatcggc

SEQ ID NO: 4438 - DNA, 490 bp, Unknown
  Ascusbbf_1797540, encodes 16S rRNA
agagtttgatcctggctcaggacgaacgctggcggcgtgcttaacacatgcaagtcgtgcggaaaggctccttcgggggtgctcgagcggcgaacgggtgagtaacacgtgagtgacctgcccttcactttgggataaccctcggaagcgggggctaataccggatatgatctgccgccgcatggtggtgggtggaaagggcccctttttggggtttggtgggggatgggctcgcggcctatcagcttgttggtggggtgatggcctaccaaggcggtgacgggtagccggcctgagagggcgaccggccacactgggactgagacacggcccagactcctacgggaggcagcagtggggaatcttgcacaatgggcgaaagcttgatgcagcgacgccgcgtgggggatgacggccttcgggttgtaaacctctttcagctctgacgaagttgcccgtgtttgcgggtggtgacggtaggggtagaaga

SEQ ID NO: 4439 - DNA, 490 bp, Unknown
  Ascusbbf_1049807, encodes 16S rRNA
agagtttgatcatggctcaggacgaacgctggcggcgtgcctaacacatgcaagtcgaacggagtacccgagaaagaagcttcggcagaaattttggaatacttagtggcggacgggtgagtaacgcgtgagcaacctgcctttaagagggggataacataccgaaaggtatgctaataccgcataacgtatgatcgtcacatggcggacataccaaagatttatcgcttagagatgggctcgcgtccgattagatagttggtgaggtaacggctcaccaagtcgacgatcggtagccggactgagaggttgaacggccacattgggactgagacacggcccagactcctacgggaggcagcagtgggggatattgcgcaatggggggaaccctgacgcagcaacgccgcgtgaaggaagaaggtcttcggattgtaaacttctgtcttatgggacgaagaatgacggtaccataggaggaagccacggc

SEQ ID NO: 4440 - DNA, 472 bp, Unknown
  Ascusbbf_1165207, encodes 16S rRNA
agagtttgatcctggctcagaacgaacgctggcggcaggcttaatccatgcaagtcaagggggtgtagcaatacacaaccggcgtacgggtgagtaacgcgtgggaatgtgtccatttgtggggaatagcttctggaaacggaaggtaataccgcatacgcccttcgggggaaagatttatcgcagatggagcggcccgcgttagattagctagttggtggggtaacggcttaccaaggcgatgatctatagctggtctgagaggacgatcagccacattgggactgagacacggcccagactcctacgggaggcagcagggaggaatattgggcaatgggggaaaccctgacccagccatgccgcgtgagtgaagaaggccttcgggttgtaaagctcttttatacgggaagatgatgacggtaccgtaagaataagcaccggctaacttcgtgccagcagccgcggtaat

SEQ ID NO: 4441 - DNA, 490 bp, Unknown
  Ascusbbf_1377586, encodes 16S rRNA
agagtttgatcatggctcaggatgaacgctagcggcaggcttaacacatgcaagtcgaggggtaacgcggggtagcaatactctggcggcgaccggcggaagggtgcgtaacgcgtgagcaacttgcccgtcactggggataggcactggaaacggtgtgtaatactccataacatatggattcacatggatttatattgaaagattcgttggtgacggatgggctcgcgtaacattagctagtcggcggggtaacggcccaccgaggctaagatgtttaggggttctgagaggaaggtcccacgacctggaactgggacacggtcccgactcctcagggaggccgcagtgaggaatattggtcaatgggcggaagcctgaaccagccatgccgcgggcaggaataaggccctatgggtcgtaaactgcttttccttgagggcaataaggatcacgtgtggtccgatgagagtatcaggggaataagcat

SEQ ID NO: 4442 - DNA, 484 bp, Unknown
  Ascusbbf_1523715, encodes 16S rRNA
agagtttgattctggctcagaacgaacgctggcggcaggcttaacacatgcaagtcgagcgcggtctttcgggactgagcggcggacgggtgagtaacgcgtgggaacgtgccttcttctctggaatagccctgggaaactgggagtaatgccggatacgcccttggcagcgatgtctgggggaaagatttatcggaggaaggtcggcccgcgttggattaggtagttggtggggtaatggcctaccaagccgacgatccatagctggtttgagaggatgaccagccacactgggactgagacacggcccagactcctacgggaggcagcagtggggaatcttggacaatgggggcaaccctgatccagccatgccgcgtgagcgatgaaggccttagggttgtaaagctctttcagcggggaagataatgacggtacccgcagaagaagccccggctaactccgtgccagcagccgcggtaat

SEQ ID NO: 4443 - DNA, 476 bp, Unknown
  Ascusbbf_555797, encodes 16S rRNA
agagtttgatcatggctcagagcgaacgctggcggcatgcttaacacatgcaagtcggacgggggtgcgtaagtgccctagtggcggacgggtgagtaacgcgtaggtatctatccataggtgggggataacattgggaaactggtgctaataccgcataatatctgagggttaaaggcgtaagttgtctatgggggagcctgcgtttgattagctagttggtggggtaaaggcctaccaaggcgatgatcgatagctggtttgagaggatgatcagccacactgggactgagacacggcccagactcctgcgggaggcagcagtggggaatattggacaatgggggcaaccctgatccagcaatgccgcgtgtgtgaagaaggtcttcggattgtaaagcactttcgacggggacgatgatgacggtacctgtagaagaagctccggctaacttcgtgccagcagccgcggtaat

SEQ ID NO: 4444 - DNA, 490 bp, Unknown
  Ascusbbf_1371864, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagcaatttccactaatcccccatattgttattctttcgcatgttaggataacgaaagcttcggtgtttacggatgcgcatgcgtgacattagctagttggtaaggtaacggcttaccaaggcgacgatgtctaggggggctgggaggcttatcccccaaactggtactgggaaccggtccagactcctacgggaggcagcagtgaggaataatggtcaatggacggaaatctgaaccagccaagccgcgtggaggaagaaggccctatgggttgtaaactccttttgttcgagagtaatatgaggcttgcgagcctcgatgagagtatcggacgaataagc

SEQ ID NO: 4445 - DNA, 490 bp, Unknown
  Ascusbbf_833984, encodes 16S rRNA
agagtttgatcatggctcaggacgaacgctggcggcgtgcttaacacatgcaagtcgaacgaagatgccgagggagcttgctcccatgccagactgagtggcggacgggtgagtaacgcgtgagtaacctgccttcaggagggggacaacttagggaaacttaagctaataccgcataatattgtaattccgcatggaggtacaatcaaagatttatcgcctgaagatggactcgcgtccgattaggtagttggtgaggcaacggctcaccaagccgacgatcggtagccggactgagaggtcgaacggccacattgggactgagacacggcccagactcctacgggaggcagcagtggggaatattgcgcaatggggggaaccctgacgcagcaacgccgcgtgaaggaagaaggttttcggattgtaaacttcagcaaacagggaagaaaaggacagtacctgattggaagccacggctaactacgtg

SEQ ID NO: 4446 - DNA, 490 bp, Unknown
  Ascusbbf_1802870, encodes 16S rRNA
agagtttgatcatggctcagagcgaacgctggcggcatgcttaacacatgcaagtcgcacgaaggtttcggccttagtggcggacgggtgagtaacgcgtaggaatctatccgtgggtgggggataactctgggaaactggagctaataccgcatgacacctgagggtcaaaggcgcaagtcgcctgcggaggagcctgcgtttgattagcttgttggtggggtaatggcctaccaaggcgacgatcagtaggggttctgagaggaaggtcccccacattggtactgagacacggaccaaactcctacgggaggcagcagtgaggaatattggtcaatgggcgagagcctgaaccagccaagtagcgtgcaggacgactgccctatgggttgtaaactgcttttatcagggaataaagtgcggcacgtgtgccgttttgtatgtacctgatgaataaggaccggctaattccgtgccagcagccgcggta

SEQ ID NO: 4447 - DNA, 490 bp, Unknown
  Ascusbbf_1758086, encodes 16S rRNA
agagtttgatcatggctcagattgaacgctggcggcatgctttacacatgcaagtcgaacggcagcgcggggcaacctggcggcgagtggcgaacgggtgagtaatatatcggaacgtacccagaagtgggggataacgtagcgaaagttacgctaataccgcatacgatctacggatgaaagtgggggaccttcgggcctcatgcttgtggagcggccgatatctgattagctagttggtagggtaaaggcctaccaaggcgacgatcagtagctggtctgagaggacgaccagccacactgggactgagacacggcccagactcctacgggaggcagcagtggggaattttggacaatgggcgcaagcctgatccagcaatgccgcgtgagtgaagaaggccttcgggttgtaaagctcttttgtcagggaagaaacggctgaggataataccttcggctaatgacggtacctgaagaataagcaccg

SEQ ID NO: 4448 - DNA, 490 bp, Unknown
  Ascusbbf_1046796, encodes 16S rRNA
agagtttgatcctggctcagaatgaacgttggcggcgtgcttaacacatgcaagtcgagcgagaaaagtcttcggacttagcaaagcggcggacgggtgagtaacgcgtgggaatctgccttttagtgaagaataccctcgagaaatcgaggttaatactgcataagtcccgtaagggagaaagatggcctctttgctgtcgctaaaagatgagcccgcgtactattagctagttggtggggtaaaggcctaccaaggcgatgatggttaaccggcctgagagggtgtacggtcacactggaactgagacacggtccagactcctacgggaggcagcagtgaggaatattgcgcaatgggcgaaagcctgacgcagcgacgccgcgtggaggatgaaggttttaggattgtaaactcctgttaagtgggaagaaacgacgagttctaataaaattcgtaactgacggtaccattagagaaagcaccggct

SEQ ID NO: 4449 - DNA, 490 bp, Unknown
  Ascusbbf_1365668, encodes 16S rRNA
agagtttgatcatggctcagaacgaacgctggcggcaggcttaacacatgcaagtcgaacggtctcttcggaggcagtggcagacgggtgagtaacgcgtgggaatctacctagttctacggaacaacagttggaaacgactgctaataccgtatacgccctatgggggaaagatttatcggaattagatgagcccgcgtaagattagctagttggtggggtaatggcctaccaaggcgacgatctttagctggtctgagaggatgatcagccacactgggactgagacacggcccagactcctacgggaggcagcagtggggaatattggtcaatgggcgagagcctgaaccagccaagtagcgtgcaggacgactgccctatgggttgtaaactgcttttatcagggaataaagtgcggcacgtgtgccgttttgtatgtacctgatgaataaggaccggctaattccgtgccagcagccgcggtaat

SEQ ID NO: 4450 - DNA, 490 bp, Unknown
  Ascusbbf_1778282, encodes 16S rRNA
agagtttgatcctggctcaagacgaacgctggcggcgtgcctaacacatgcaagtcgagcgatgaaaaagaagtagatctcatcggagtgacacctctttggattagcggcggacgggtgagtaacacgtgagcaacctgccgtacacattgggatagcctcgggaaactgggattaataccaaacgaaacatattgatagcattatcaaaatgtcaaagatttatcggtgtacgatgggctcgcgtctgattagctagttggtgagataaaagctcaccaaggcaatgatcagtagccggcctgagagggtgatcggccacattgggactgagacacggcccaaactcctacgggaggcagcagtggggaatattgcacaatggagggaactctgatgcagcgacgccgcgtgagcgaagaaggaattcgtttcgtaaagctctgtcctatgggaagataatgacggtaccatagaagaaagccccggc

SEQ ID NO: 4451 - DNA, 470 bp, Unknown
  Ascusbbf_463881, encodes 16S rRNA
agagtttgatcctggctcagaatgaacgctggcggcaggcctaaaacatgcaagtcgaacgcatccttcgggatgagtggcgcacgggtgagtaacatgtgggaatatgccttttggtacggaacaacttttggaaacgaaagctaataccgtatggtcccttcggggtaaagatttatcgccaaaagattagcccgcactagattagctagttggtgaggtaagagctcaccaaggcgacgatctatagctggtctgagaggacgatcagccacactgggactgagacacggcccagactcctacgggaggcagcagttaggaatattggacaatgggcgcaagcctgatccagccatgccgcgtgaacgatgaaggccttcgggttgtaaagttctttagccgacgaatataatgactgtagtcggagaataagccccggctaacttcgtgccagcagccgcggtaat

SEQ ID NO: 4452 - DNA, 490 bp, Unknown
  Ascusbbf_465117, encodes 16S rRNA
agagtttgatcatggctcagaatgaacgctggcggcatggattaggcatgcaagtcgaacgccgcggtttcggccgcggagtggcgaaagggtgcgcaacgcgtggggaacctgcccccgggtccgggacaagcgctggaaacggcgtctgatacgggatgcggatccgcctggcatcaggcggcgtccaaagattcatcgcccggggagggccccgcgtcccattagctagttggcggggtaacggcccaccaaggcaacgacgggtaggtggtctgagaggatggtcacccacactgggactgagacactgcccagactcctacgggaggctgcagtcgagaatcttccgcaatgggcgcaagcctgacggagcgatgccgcgtgagggatggaggccttcgggtcgtgaacctctgtcacccgggacgaagaattgacggtaccgggagaggaagccacggctaactacgtgccagcagccgcggta

SEQ ID NO: 4453 - DNA, 484 bp, Unknown
  Ascusbbf_693845, encodes 16S rRNA
agagtttgatcctggctcagaacgaacgctggcggcaggcttaacacatgcaagtcgagggaggacttcggtcctagcggcggacgggtgagtaacgcgtgggaacgtgcccttctctctggaatagccctgggaaaccgggagtaatgccggatacgccgtttcgtggagacacgggatgggaaagatttatcggtgaaggatcggcccgcgttggattaggtagttggtggggtaatggcctaccaagccgacgatccatagctggtttgagaggatgatcagccacactgggactgagacacggcccaaactcctacgggaggcagcagtggggaatcttggacaatgggggcaaccctgatccagccatgccgcgtgagcgatgaaggccttagggttgtaaagctctttcagcggggaagataatgactgtacccgcagaagaagccccggctaactccgtgccagcagccgcggtaat

SEQ ID NO: 4454 - DNA, 490 bp, Unknown
  Ascusbbf_1375010, encodes 16S rRNA
agagtttgatcctggctcaggatgaacgctagctacaggcttaacacatgcaagtcgaggggtaacatggaggtagcaatacttctgatgacgaccggcgcactggtgagtaacacgtatgcaacctgcccctgtcagtgggataatccagggaaacttggtctaataccgcatgacacgtcccggggcctcccgggacgttgaaagattcgtttcggacagggatgggcatgcgcagcattagctggttggtggggtaacggcccaccaaggcgacgatgcttaggggttctgagaggaaggtcccccacactggtactgagacacggaccagactcctacgggaggcagcagtgaggaatattggtcaatggccgcagggctgaaccagccaagtcgcgtgagggaagacggccctacgggttgtaaacctcttttgccggggagtaacgatgcggacgcgtccgcagctgagagtacccggagaaaa

SEQ ID NO: 4455 - DNA, 490 bp, Unknown
  Ascusbbf_1330127, encodes 16S rRNA
agagtttgatcctggctcaggatgaacgctagcggcaggcctaatacatgcaagtcgaacggtcagtagcaatactgatagtggcgcacgggtgcgtaacacgtaactaacctacctataactgggggatagcccgccgaaaggcggattaataccgcataagctgtttgagtggcatcactcgattagtaaagatttattggttatagatggggttgcgggtcattagctagttggtaaggtaacggcttaccaaggcgacgacgactaggggagctgagaggctggtcccccacacgggcactgggatacgggcccgactcctacgggaggcagcagtagggaatattgggcaatgggcgagagcctgacccagccatgccgcgtgcaggaagaaggctttctgagtcgtaaactgcttttgacagggaagaataagccttacgtgtagggtgatgacggtacctgcagaataagcaccggctaactc

SEQ ID NO: 4456 - DNA, 490 bp, Unknown
  Ascusbbf_673963, encodes 16S rRNA
agagtttgatcctggctcaggatgaacgctagcggcaggcttaacacatgcaagtcgaggggcagcatgggactgagattcgtcgaagtcctgatggcgaccggcgcaagggtgcgtaacgcgtgagcaacttgcccgtttcagggggataaccggtggaaacgccgactaataccccatggtattgggttcaggcatctttacccaattaaagaatttcggaaacggataggctcgcgtgacattagctagatggcggggtaacggcccaccatggcgacgatgtctaggggttctgagaggaaggtcccccacactggaactgagacacggtccagactcctacgggaggcagcagtgaggaatattggtcaatggtctgacgactgaaccagccatgccgcgtgaaggtcacggccctatgggtcttaaacttcttttgtaagggagcaataagtcccacgtgtgggatgatgagagtaccttacga

SEQ ID NO: 4457 - DNA, 490 bp, Unknown
  Ascusbbf_1552603, encodes 16S rRNA
agagtttgatcctggctcaggacgaacgctggcggcgtggattaggcatgcaagtcgagcgatatccaaccttcgggttggtgaaagcggcgaacgggtgagtaacacgtgaacaacctgccctcacattctggataatagaccgaaaggtcttgtaatacaggcgaggatttctcttaggcatctttgagaaagggaaggcgcaagccgtgcgaggaggggttcgcggattatcaggtagatggtgaggtaacggctcaccatgccgacgacgattaggtggtctgagaggatggtcacccacattgggactgagacactgcccagactcctacgggaggctgcagtcgagaatcttgcacaatgtacgaaagtatgatgcagcgacgccgcgtgaaggatgaaggccctctgggtcgtaaacttcttttatgtgggaagaataaatgacggtaccacatgaataagccacggctaactacgtgccagc

SEQ ID NO: 4458 - DNA, 470 bp, Unknown
  Ascusbbf_776298, encodes 16S rRNA
agagtttgatcatggctcagaacgaacgctggcggcaggcttaacacatgcaagtcgagcgggcacttcggtgtcagcggcagacgggtgagtaacgcgtggggatctgcctagtggtacgggacaactcagggaaacttgagctaataccgtataagtccttcgggagaaagatttatcgccactagatgaacccgcgtctgattagctagttggtagggtaatggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcgctggggaagataatgacggtacccagataagaagccccggctaacttcgtgccagcagccgcggtaat

SEQ ID NO: 4459 - DNA, 490 bp, Unknown
  Ascusbbf_1620527, encodes 16S rRNA
agagtttgatcctggctcaggatgaacgctagctacaggcctaacacatgcaagtcgaggggcatcatgggagaagctcgcttttcccgatggcgaccggcgaatgggtgagtcacgcgtgtccaacctgcccccggcccggggatagcccttggaaatgaggattaacacccgatatgtggtttcgccgcatggcgtttccatgaaacgaggccggggatggggatgcgtcggattagcttgacggtggggcgacggcccaccgtggcgacgatccgcaggggttctgagaggaaggtcccccacactggcactgagacacgggccagactcctacgggaggcagcagtgaggaatattggtcaatggccgagaggctgaaccagccaagtagcgtgcaggacgacggccctacgggttgtaaactgcttttgcgggaggataaagtgcgccacgcgtggcgctttgcaggtatcccgtgaataaggac

SEQ ID NO: 4460 - DNA, 488 bp, Unknown
  Ascusbbf_960053, encodes 16S rRNA
agagtttgatcatggctcagaacgaacgctggcggcaggcttaacacatgcaagttgaacggtattgttgagtagcttgctatttgacaagagagtagcgcattggtgagtaacacgtgggaacgtaccttttggtggggaataacgtttggaaacgaacgctaataccgcataagccctgagggggaaagatttatcgccgaaagaacggcccgcggaagattaggtagttggtggggtaacggcctaccaagccgacgatctatagctggtctgagaggacgatcagccacattggaactgagacacggtccaaactcctacgggaggcagcagtgaggaatattgggcaatggaggaaactctgacccagccatgccgcgtgagtgaagaaggtcttcggattgtaaagctctttcggataagacgatgatgacggtattatctaaagaagccccggctaacttcgtgccagcagccgcggtaat

SEQ ID NO: 4461 - DNA, 490 bp, Unknown
  Ascusbbf_1339138, encodes 16S rRNA
agagtttgatcatggctcagattgaacgctggcggcaggcctaacacatgcaagtcgagcggcatcagggagtagcttgctactctgctggcgagcggcggacgggtgagtaatgtatggggatctgcctgatggagggggataactactggaaacggtagctaataccgcataatctcgcaagagcaaagggtgggaccttcgggccacttaccatcagatgaacccatatgggattagctagtaggtgtggtaaaggcgcacctaggcgacgatctctagctggtctgagaggatggacagccacactgggactgagacacggcccagactcctacgggaggcagcagtggggaatattgcacaatgggggaaaccctgatgcagccatgccgcgtgtatgaagaaggccttcgggttgtaaagtactttcagtgatgaggaagtttctttgtttaagagatgagggaattgacgttagtcacagaag

SEQ ID NO: 4462 - DNA, 487 bp, Unknown
  Ascusbbf_1275669, encodes 16S rRNA
agagtttgatcatggctcaggacgaacgctggcggcgtgcttaatacatgcaagtcgagcgagtgtagcaatacacgagcggcggacgggtgagtaacgcgtgggcaacctgccctctagcctgggataacagttcgaaaggactgctaacaccggatattctcacagggagacatctcccagtgaggaaagtttacactagaggatgggcccgcgtcccattagcttgttggtgaggtaacggctcaccaaggcgacgatgggtagccgacctgagagggtgatcggccacactgggactgagaaacggcccagactcctacgggaggcagcagtagggaattttccgcaatgggcgaaagcctgacggggcaacgccgcgtgagggatgaaggttttcggatcgtaaacctctgtcttcagggaagataatgacggtacctgaggaggaagccacggctaactacgtgccagcagccgcggtaat

SEQ ID NO: 4463 - DNA, 488 bp, Unknown
  Ascusbbf_388487, encodes 16S rRNA
agagtttgatcctggctcagaacgaacgctggcggcaggcctaacacatgcaagttgaacgagaacttgggatagcttgctattttgagtgagagtagcgcacgggtgagtaacacatgggaacataccgtatagtggggaataacagttggaaacggctgctaataccgcataatccctgagggggaaagatttatcgctaaacgaatggcccatggcagattaggtagtaggtggggtaatggcctacctagccgacgatctgtagctggtctgagaggacgatcagccacattgggactgagacacggcccagactcctacgggaggcagcagtgaggaatattgggcaatgggggcaaccctgacccagccatgccgcgtgagtgaagaaggttttcggattgtaaagctctttcagatgtgaagatgatgacggtagcatcagaagaagccccggcaaacttcgtgccagcagccgcggtaat

SEQ ID NO: 4464 - DNA, 490 bp, Unknown
  Ascusbbf_1543400, encodes 16S rRNA
agagtttgatcatggctcaggacgaacgctggcggcgtgcttaacacatgcaagtcgaacgctgaagcactagcttgctggtgtggatgagtggcgaacgggtgagtaacacgtgagtaacctgccccggactctggggtaagcgctggaaacggtgtctaataccggatacgacctatcaccgcatggtgtgtgggtggaaagactgtgtcggtttgggatggactcgcggcctatcagcttgatggtgaggtaatggctcaccatggcgacgacgggtagccggcctgagagggtgatcggccacactgggactgagacacggcccagactcctacgggaggcagcagtggggaatattgcacaatgggcgcaagcctgatgcagaacgccgcgtgagggatgacggccttcgggttgtaaacctcttttagtaaggaagaagccttcgggtgacggtacttgcagaaaaagcaccggctaactacgt

SEQ ID NO: 4465 - DNA, 490 bp, Unknown
  Ascusbbf_1338071, encodes 16S rRNA
agagtttgatcatggctcaggacgaacgctggcggcgtgcctaacacatgcaagtcgaacggagttaagacttcggttttaacttagtggcgaacgggtgagtaacgcgtgagaaacctacctttcagtgggggacaacagttggaaacgactgctaataccgcataatgtagcgtcggggcatcccgatgctaccaaagctttatgtgctgaaagatggtctcgcgtctgattagctagttggtgaggtaacggctcaccaaggcgacgatcagtagccggtctgagaggatgaacggccacattgggactgagatacggcccagactcctacgggaggcagcagtggggaatattgggcaatgggggaaaccctgacccagcaacgccgcgtgaaggaagaaggccttcgggttgtaaacttcttttaccagggacgaagaacgtgacggtacctggagaaaaagcaacggctaactacgtgccagca

SEQ ID NO: 4466 - DNA, 490 bp, Unknown
  Ascusbbf_613688, encodes 16S rRNA
agagtttgatcctggctcaggacgaacgctggcggcgcgcttaacacatgcaagtcgaacgtgaagcccgggcttgcccgggtggaaagtggcgaacgggtgcgtaacacgtgagcaacctgccccgaagaccgggataacaccgggaaaccggtgctaataccggataccctcatatcgtcgcatggcgaaatgaggaaatggattccgcttcgggatgggctcgcggtctatcagcttgttggtggggtaacggctcaccaaggctacgacggatagctggtctgagaggatgtccagccacactgggactgagacacggcccagactcctacgggaggcagcagtggggaatcttgcacaatgggcgaaagcctgatgcagcgacgccgcgtgcgggatgacggccttcgggttgtaaaccgctttcagcagggacgattatgacggtacctgcagaagaagccccggccaactacgtgccagcagc

SEQ ID NO: 4467 - DNA, 490 bp, Unknown
  Ascusbbf_762065, encodes 16S rRNA
agagtttgatcatggctcaggatgaacgctagcggcaggcttaatacatgcaagtcgaggggtaacaggggagcttgctcccgctgacgaccggcaaacgggtgcggaacacgtacacaaccttccttttagtggggaatagcccagggaaacttggattaataccccgtaacatgttgataaggcatcttattaatattatagcagcaatgcgctagaagacgggtgtgcgcatgattaggtagttggcggggtaatggcccaccaagcctacgatcattaactggtgtgagagcacgaccagtcacacgggcactgagacacgggcccgactcctacgggaggcagcagtaaggaatattggtcaatggaggaaactctgaaccagccatgccgcgtggaggatgaaggtcctctggattgtaaacttcttttatatgggacgaaaaaagggttttctaactcgtctgacggtaccatatgaataagc

SEQ ID NO: 4468 - DNA, 490 bp, Unknown
  Ascusbbf_959611, encodes 16S rRNA
agagtttgatcctggctcaggacgaacgctggcggcgtgcttaacacatgcaagtcgagcggtaaggccttcgggtacacgagcggcgaacgggtgagtaacacgtgggtgatctgccctgtacttcgggataagcctgggaaactgggtctaataccggatatgaccgcttctcgcatggggggtggtggaaagccttgtgcggtatgggatgggcccgcggcctatcagcttgttggtggggtaatggcctaccaaggcgacgacgggtagccggcctgagagggcgaccggccacactgggactgagacacggcccagactcctacgggaagcagcagtggggaatattgcacaatgggcgcaagcctgatgcagcgacgccgcgtgggggatgacggccttcgggttgtaaacctctttcgcctacgacgaagcgagagtgacggtagtaggagaagaagcaccggccaactacgtgccagcagcc

SEQ ID NO: 4469 - DNA, 487 bp, Unknown
  Ascusbbf_1736682, encodes 16S rRNA
agagtttgatcatggctcagggtaaacgctggcggcgtgcctaaaacatgcaagtcgaacgagaacttcggttcgagtggcagacggctgagtaacacgtggatgacctgcccgactgtggggaataactgcccgaaagggtggctaataccgcatacgttcccagattcgattttgggaggaaagctcgcaagggcgcagatggaggggtccgcggccgattagctagttggtggggtaacggcctaccaaggcgacgatcggtagctggtctgagaggatgatcagccagactgggactgagacacggcccagactcctacgggaggcagcagttaggaattttgggcaatgggcgaaagcctgacccagcaacgccgcgtgggtgacgaaggccttcgggtcgtaaagcccttttctgagggaagatagtgacggtacctcaggaagaagcaccggctaactacgtgccagcagccgcggtaat

SEQ ID NO: 4470 - DNA, 165 bp, Unknown
  Ascusbbf_476641, encodes 16S rRNA
agagtttgatcatggctcagtatctgccagcagccgcggtaatagagtttgatcatggctcagccagcagccccggtaatgccagcagccgcggtaataccagcagccgtggtaatctgtctagagtttgatcctggctcagactctgccagcagccgcggtaat

SEQ ID NO: 4471 - DNA, 488 bp, Unknown
  Ascusbbf_1532857, encodes 16S rRNA
agagtttgatcatggctcagaacgaacgctggcggcaggcttaacacatgcaagtcgaacgccccgcaaggggagtggcagacgggtgagtaacgcgtgggaacgtaccctttactacggaataactcagggaaacttgtgctaataccgtatgtgcccttcgggggaaagatttatcggtaaaggatcggcccgcgttggattagctagttggtggggtaaaggctcaccaaggcgacgatccatagctggtctgagaggatgatcagccacactgggactgagacacggcccagactcctacgggaggcagcagtgaggaatattggtcaatgggcggtagcctgaaccagccaagtcgcgtgagggatgacggccccacgggttgtaaacctcttttgtcggggagtaacccgctccacgtgtggagcgctgagagtacccggcgaataagcatcggctaactccgtgccagcagccgcggtaat

SEQ ID NO: 4472 - DNA, 490 bp, Unknown
  Ascusbbf_1629951, encodes 16S rRNA
agagtttgatcatggctcaggatgaacgctggcggcgcgcctaacacatgcaagtcgaacggccggaccacctcggtgggcgaggcagtggcgaacggctgagtaacacgtgggcaacctgcctatcagaggggaacaacagttagaaatgactgctaataccgcatatgcctaagcatcacatggtgcaatagggaaaggagcaatctgctgatagatgggcttgcgtctgattagatagttggtggggtaacggcctaccaagtcgacgatcagtagccggactgagaggttgaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagaaaaaagacagtacctgtagaataagctccggctaactacgtgccagcag

SEQ ID NO: 4473 - DNA, 490 bp, Unknown
  Ascusbbf_1782261, encodes 16S rRNA
agagtttgatcctggctcaggatgaacgctggcggcgtgcttaacacatgcaagtcgaacgaagcacttaagattgactcttcggatgacgtcttttgtgacttagtagcggacgggtgagtaacgcgtgggtaacctgcctcacacagggggataacagttagaaatgactgctaataccgcataacccgataggatcgcatgatccagacggaaaagatttatcggtgtgagatggacccgcgtctgattagttagttggtggggtaagagcctaccaagacgatgatcagtagccgagctgggaggctggccggccacattgggactgagatacggcccagactcctacgggaggcagcagttgggaatattgggcaatggaggaaactctgatccagtgacgccgcgtgaaggaagaaggtcttcgaattgtaaacttattttatcagggaagaagaaagtgacagtacctgaagaaaaaggaccg

SEQ ID NO: 4474 - DNA, 490 bp, Unknown
  Ascusbbf_647293, encodes 16S rRNA
agagtttgattatggctcagaacgaacgctggcggcgtgcctaacacatgcaagtcgagcgagaaagggcccttcggggcctgagtaaagcggcggacgggtgagtaacacgtgagtaacgtgccttcgagtgggggataactgtccgaaaggacagctaataccgcatgagaccacagcggcttcggccgccggggtcaaagccttcgggcgctcgaagattggctcgcggaccattagctagttggtggggtaatggcccaccaaggctgagatggttagctggtctgagaggatgatcagccacactgggactgagacacggcccagactcctacgggaggcagcagtggggaatcttgcgcaatgggcgaaagcctgacgcagcaacgccgcgtgtgtgatgaaggctttcgggtcgtaaagcactgtcaggagggaagattgtgacggtacctccagaggaagcaccggctaactccgtgccagc

SEQ ID NO: 4475 - DNA, 490 bp, Unknown
  Ascusbbf_993850, encodes 16S rRNA
agagtttgatcctggctcagaacgaacgctggcggcgcgcttaacacatgcaagtcgagcggtccggggcaactcgggcagcggcgaacgggtgagtaacacgtggataatctgccctcgagacagggataacccggggaaactcgggctaataccagataagcttccggagaggcatctctctgggggaaaaggggcaacccactcgaggatgagcccgcggcccattagctagttggcggggtaaaggcccaccaaggcgacgacgggtagctggtctgagaggacgaccagtcacactggaactgagacacggtccagactcctacgggaggcagcagtggggaatcttgcgcaatgggcgaaagcctgacgcagcgacgccgcgtgtgcgatgaaggtcttcggatcgtaaagcactgtcgcgagggaagaaacctgacggtacctcgagaggaagcaccggctaactctgtgccagcagccgcgg

SEQ ID NO: 4476 - DNA, 490 bp, Unknown
  Ascusbbf_1080628, encodes 16S rRNA
agagtttgatcctggctcaggacgaacgctggcggcgtgcttaacacatgcaagtcgagcggaaaggccactccggtggtactcgagcggcgaacgggtgagtaacacgtgagtaatctgccctccactttgggatagccaccggaaacggtgattaataccagatatgacatggatccgcatgggtttgtgtggaaagtttttcggtgggggatgtgctcgcggcctgtcagcttgatggtgaggtaatggctcaccatggcttcgacgggtagccggcctgagagggtgaccggtcacactgggactgagacacggcccagactcctacgggaggcagcagtggggaatattggacaatgggcggaaacctgatccagcaacgccgcgtgagggatgacggccttcgggttgtaaacctctttcgcctaggacgaagcgagagtgacggtactaagtaaagaagcaccggccaactacgtgccagcag

SEQ ID NO: 4477 - DNA, 233 bp, Unknown
  Ascusbbf_536008, encodes 16S rRNA
agagtttgatcatggctcagccatcgcaccctcattccaatagaattccaatagacgattgtctatgaacatcatggaccgtgacatagaagtctgtcaatgcgatgtgcggtcgagcgcctgcgcggcgaggcgttcctcgccggccgcccgccagacctcacgggccgccgtcgcgttgagcgcgacgatgaacaggccgagcacgatgtcgggccagcagccgcggtaat

SEQ ID NO: 4478 - DNA, 490 bp, Unknown
  Ascusbbf_1435514, encodes 16S rRNA
agagtttgatcctggctcaggacgaacgctggcggcgtgcttaacacatgcaagtcgagcggtaaggccctttcgggggtacacgagcggcgaacgggtgagtaacacgtgagtaatctgcccttcacttcgggataactaccggaaacggtgtctaataccggatatgaccacgtactgcatggtgtgtggtggaaagttctggcggtgaaggatgtgctcgcggcctatcagcttgttgttgaggtaatggctcaccaatgcttcgacgggtagccggcctgagagggtgaccggccacactgggagtgagacacggcccagactactacgggaggcagcaggggggaatattggacaatggccgaaagcctgatacagccacgccgcgtgagggatgactgccttcgggttgtaaacctctttcagtaccgacgaagcgagagtgacggtaggtacagaagaagctccggccaactacgtgccagca

SEQ ID NO: 4479 - DNA, 490 bp, Unknown
  Ascusbbf_1152728, encodes 16S rRNA
agagtttgatcctggctcaggacgaacgctggcggcgggtttaacacatgcaagtcgagggacgaagcctacttcggtgggtggagaccggcgaacgggtgagtaacacgtgaggaacctacccggtacttcgggataaccgcgggaaaccgtggctaataccggatattccgagtctgacgcatgtcgggtttgggaaagttcaggcggtatcggacggcctcgcggcgtatcagcttgttggtggggtaatggcttaccaaggcgacgacgcgtagctggagtgagagctcgatcagccacactgggactgagacacggcccagactcctacgggaggcagcagtggagaatcttgcacaatgggcgaaagcctgatgcagccacgccgcgtgcgggaagaaggccttcgggtcgtaaaccgctttcaggggggaagaagcgtcaagtgacggtacctccagaagaaggaccggccaactacgtgcca

SEQ ID NO: 4480 - DNA, 490 bp, Unknown
  Ascusbbf_1806986, encodes 16S rRNA
agagtttgatcctggctcagagcgaacgctggcggcatgcttaacacatgcaagtcgcacgaaggtttcggccttagtggcggacgggtgagtaacgcgtaggaatctatccatgggtgggggataactctgggaaactggagctaataccgcatgatacctgagggtcaaaggcgtaagtcgcctgtggaggagcctgcgttcgattagcttgttggtgaggtaacggcccaccaaggcgatgatacatagccggtctgagaggatgaacggccacattgggactgagacacggcccagactcctacgggaggcagcagtaaggaattttcggcaatggacgaaagtatgaccgagcaacgccgcgtgagtgatgaaggccttcgggtcgtaaagctctgtggtaagggaagaatactgtgaataggaaatgattcacagctgacggtacctttctagaaagtcacggcttactacgtgccagcagccg

SEQ ID NO: 4481 - DNA, 490 bp, Unknown
  Ascusbbf_1435498, encodes 16S rRNA
agagtttgatcatggctcaggatgaacgctggcggcgtgcctaatacatgcaagtcgaacgaggtggaagggagcttgctcctggatgcctagtggcgaacgggtgcgtaacacgtaggtaacctgcccttaagcttgtgatacccagaggaaactttggctaataccggataacaacagaggaggcatctcctttgcttgaaaggcccttcacggggtcacttaaggatggacctgcggcgcattagctagttggtgagataaaggcccaccaaggcgaggatgcgtagccgccctgagagggggatcggccacatgggaaacgggacacggtccaaactcctaagggaggcagcagtaaggagttttcggcaatgggggaaaccctgaccgagcaacgccgcgtgagtgatgacggccctatgggttgtaaagagctgttgtaagggacgaacgatcggttaggaaaggaaacggttctgacagtacc

SEQ ID NO: 4482 - DNA, 481 bp, Unknown
  Ascusbbf_476144, encodes 16S rRNA
agagtttgatcctggctcagaacgaacgctggcggcgtgcttaacacatgcaagttgaacgagaggcagtagcaatactgtagtaaagtagcagacgggtgagaaacacgtgggaaacttccttttagtaaagaatagcccagggaaacttggattaatactttatacgccctacgggggaaagatttatcgctaaaagatgtgcccgcgtaagattaggtagttggtggggtaatggcctaccaagcctacgatctttagctggtctgagaggatgatcagccacactgggactgagacacggcccagactcctacgggaggcagcagtggggaatattggacaatgggcgcaagcctgatccagcaacgccgcgtgaatgatgaaggccttcgggttgtaaagttcttttagcagggaagaaaatgacggtacctgcagaataagctccggctaacttcgtgccagcagccgcggtaat

SEQ ID NO: 4483 - DNA, 174 bp, Unknown
  Ascusbbf_472393, encodes 16S rRNA
agagtttgatcatggctcagccatcagcaggatcttatgcgggacttcgccagcttccaagcgctcatggaaatcagcggcttgcggctgggcagaagtgatgcgcacctctgtctgcacgcgttcattcgccacatctttgacataccagtgatagccagcagccgcggtaat

SEQ ID NO: 4484 - DNA, 490 bp, Unknown
  Ascusbbf_1428425, encodes 16S rRNA
agagtttgatcctggctcaggacgaacgctggcggcgtgcttaacacatgcaagtcgaacgatgaagctccagcttgctggggtggaagagtggcgaacgggtgagtaacacgtgagtaacctgcccatcacttcgggataagcgctggaaacggtgtctaatactggatatgacccatcaccgcatggtgtgtgggtggaaagatttattggtggtggatggactcgcggcctatcagcttgatggtggggtaatggcctaccatggcgacgacgggtagctggcctgagagggtgaccggccacactgggactgagacacggcccagactcctacgggaggcagcagtggggaatattgcacaatgggcgcaggcctgatgcagcaacgccgcgtgagggatgacggccttcgggttgtaaacctcttttagtagggaagaagcgcaagtgacggtacctgcagaaaaagcaccggctaactacgtgc

SEQ ID NO: 4485 - DNA, 490 bp, Unknown
  Ascusbbf_1432110, encodes 16S rRNA
agagtttgatcctggctcaggacgaacgctggcggcgtggattaggcatgcaagtcgcgcgacggaccttcgggttacggagcggcgaacgggtgagtaacacgtgagaaacctaccgcatcattccggataattgatcgaaaggtcttgtaatacgggggaggttcgttgatgggcatccattgacgaacgaacgggcaaccggtgctgtgatggtctcgcggcttatcaggtagttggtggggtaacggcctaccaagcctacgacgagtagctggtctgagaggatggtcagccacattggtactgagacactgtccagactcctacgggaggctgcagtcgagaatcttgggcaatgcacgaaagtgtgacccagcgacgccgcgtgaaggatgaaggccctctgggtcgtaaacttcttttacgggagaagaagaactgacggtatcccgtgaataagccacggctaactacgtgccagcagccg

SEQ ID NO: 4486 - DNA, 490 bp, Unknown
  Ascusbbf_1151987, encodes 16S rRNA
agagtttgatcctggctcaggatgaacgctagcggcaggcttaacacatgcaagtcgaggggtaacgggggcgcttgcgcccgccgacgaccggcgcacgggtgagtaacgcgtacactacctgcccaatggcgggggatagcccggggaaacccggattaaccccccatggtccccagagtgggcatccactttggggcaaacattcatggccattggatgggtgtgcgtcccattagcttgttggtaaggtaacggcttaccaaggcgatgatgggtaggggccctgagagggggatcccccacactggtactgagacacggaccagactcctacgggaggcagcagtgaggaatattggacaatgggcgggagcctgatccagccatgccgcgtgcgggaagacggccctatgggttgtaaactgcttttgtatggggataaagtgctccacgtgtggagttttgtaggtaccatacgaataaggac

SEQ ID NO: 4487 - DNA, 490 bp, Unknown
  Ascusbbf_1322198, encodes 16S rRNA
agagtttgatcctggctcaggataaacgctggcggcgcacataagacatacaagtcgaacgaacttaatcgaaagtttacttttgaagcggttagtggcggactggtgagtaacgcgtaagcaatctgcctatcagaggggaataacagtgagaaatcattgctaataccgcataagctgtgagtatcgcatgatacacagagaaaaggagcaacccgctgattgatgagcttgcgtctgattagttagttggtggggtaacggcgtaccaagacgatgatcagtagccggactgagagggtaaacggccacatggggactgggatacgacccagacgcctccgggaggcagcagtcgggaatattgcgcaatggaagaaactctgacgcagtgacgctgcgggcaggaagaaggttttcggattgtaaactgctttagatagggaagaaaaaaatgacggtacctatagaataagctccggctaactac

SEQ ID NO: 4488 - DNA, 490 bp, Unknown
  Ascusbbf_1293565, encodes 16S rRNA
cgagttttctcctttctccttctccccgcttgcggcgcacctaagacatgcaagtcaaacggacttaactcattcttaacgattgagagcggttagtggcggactggtgagtaatgtataagtaacctgcctatcagaggggaacaacagttggaaacgactgctaataccgcatatgccacgagaatcacatggttcaagtgggaaaggagcaatccgctgatagatggacttatatctgattagctagttggtggggtaacggcctaccaaggcgacgatcagtagccggactgagaggttaaacggccacattgggactgagatacggcccagactcctacgggaggcagcagtcgggaatattgcgcaatggaggaaactctgacgcagtgacgccgcgtgcaggaagaaggttttcggattgtaaactgctttagacagggaagaaaaaagacagtacctgtagaataagctccggctaactacg

SEQ ID NO: 4489 - DNA, 486 bp, Unknown
  Ascusbbf_1341741, encodes 16S rRNA
agagtttgatcatggctcagaacgaacgctggcggcaggtcttaggcatgcaagtcgaacggacgacagagtggcttgccattctgcagttagtggcgcacgagtgagtaacgcgtgggcaactgcccttcactggggaataacgtctggaaacggacgctaataccgcatacgcccgcacggggaaagatttatcggtgatggatgtgcccgcgttggattcgcttgttggtggggtaatggcctaccaaggcgatgatccatagctggtctgagaggacgatcagccccgctggaacttggacacgggccagaatacgacgggaggcagaagctaagaatattgggcaatggaggaaactctgacccagccatgccgcgtgaatgaagaaggccttcgggttgtaaagttctttgagtcatgaagaggatgacagtagtgacagaaaaagcaccggctaacttcgtgccagcagccgcggtaat

SEQ ID NO: 4490 - DNA, 490 bp, Unknown
  Ascusbbf_590956, encodes 16S rRNA
agagtttgatcctggctcaggatgaacgctggcggcgtgcttaacacatgcaagtcgaacggagctattttggaagcctccttcgggagacggaagatttagcttagtggcggacgggtgagtaacgcgtgagtaacctggcctcaagagggggacaacagctggaaacggctgctaataccgcataaggtaacggagtcgcatggctctgttactaaaggagcaatccgcttgaggatggactcgcgtctgattaggtagttggcggggtaacggcccaccaagccgacgatcagtagccggactgagaggttggccggccacattgggactgagacacggcccagactcctacgggaggcagcagtggggaatattgggcaatgggcgaaagcctgacccagcaacgccgcgtgaaggaagaaggccctcgggttgtaaacttctttgacaggggacgataatgacggtaccctgaaaacaagctccg

SEQ ID NO: 4491 - DNA, 490 bp, Unknown
  Ascusbbf_479587, encodes 16S rRNA
agagtttgatcctggctcaggatcaacgctggcggcgtgcctaatgcatgcaagtcggacggggtcaccttcgggtggctcacgtggcggacgggtgaggaacacgtggggaagctgccgtgcgcacgggggtagccatcggaaacggtgggtaattccggatgcgctcgccgcccgggtaggggtggtgaggaaagatcttcggatcggcgcacgaggcacctgcggccgattagctggttggtggggtcacggctcaccaaggcgatgatcggtagctggtctgagaggacgatcagccacacggggactgagacacggccccgactcctacgggaggcagcagcaaggaattttccgcaatgggcgcaagcctgacgcagcaacgccgcgtgatcgagacgcttttcggagtgtaaagatctgtcagtggggacgaagaatgactgtacccacagaggaagcaccggctaactccgtgccagcagcc

SEQ ID NO: 4492 - DNA, 490 bp, Unknown
  Ascusbbf_760747, encodes 16S rRNA
agagtttgatcatggctcagaacgaacgctggcggcgcgtcttaagcatgcaagtcgagcgggaggggcagcgatgccccgagagcggcggacgggtgagtaacgcgtggacaaccgaccctccggtgggggatagccgagcgaaagcgcggataataccgcatgagacggagcgggggcggccctgttccgggaaagcgcctgcgggcgcgccgggggacgggtctgcgtcccatcagctagacggcggggtgaaggcccaccgtggcgacgacgggtagccggcctgaaagggtgaacggccacattggaactgatacacggtccagactcctacaggaggcagcagtggggaatattgcgcaatgggggaaaccctaacgcagcgacaccatgtgaaggatgaaggccctagggttgtaaacttctgtctagaggaaagaatcaatgacggtacctctaaagaaagcaccggctaactccgtgccag

SEQ ID NO: 4493 - DNA, 489 bp, Unknown
  Ascusbbf_1695477, encodes 16S rRNA
agagtttgatcctggctcaggatgaacgctggcggcgtgcctaacacatgcaagtcgagcgattctcttaggagaagagcggcggacgggtgagtaacgcgtgggtaacctgccctgtacacactgataacataccgaaaggtatgctaatacgggataatatattttgatggcatcatcgaaatatcaaagctccggcggtacaggatgggcccgcgtctgattagctagttggtggggtaatggctcaccaaggcgacgatcagtagccgacctgagagggtgatcggccacattggaactgagacacggtccaaactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaat

SEQ ID NO: 4494 - DNA, 490 bp, Unknown
  Ascusbbf_976186, encodes 16S rRNA
agagtttgatcctggctcagattgaacgctggcggcatgcttaacacatgcaagtcgaacggcagcatgatctagcttgctagattgatggcgagtggcggacgggtgagtaacgcgtaggaatatgccttgaagcgggggataacctgaggaaactcaggctaataccgcataatctctgcggagaaaagctggggaccttatggcctggcgcttcaagaatagcctgcgttcgattagctagttggtagggtaaaggcctaccaaggcgacgatcgatagctggtctgagaggatgatcagccacactgggactgagacacggcccagactcctacgggaggcagcagtggggaatattggacaatgggggcaaccctgatccagcaatgccgcgtgtgtgaagaaggcctgagggttgtaaagcactttcagtggggaggaggcttgataggttaagagctaattaagtggacgttacccacagaag

SEQ ID NO: 4495 - DNA, 490 bp, Unknown
  Ascusbbf_623928, encodes 16S rRNA
agagtttgatcctggctcaggatgaacgctagcgacaggcttaacacatgcaagtcgaggggcagcgcggaggtagcaatacttctggcggcgaccggcgcactggtgagtaacacgtatgcgacctgccccggacagggggataaacccgggaaactgggcctaataccccatatgccctgagggtgcatgcccttggggtgaaagatccgtcggtccgggatgggcatgcggcgcattagctggttggcggggcaacggcccaccaaggcgacgatgcgtaggggttctgagaggaaggtcccccacactggtactgagacacggaccagactcctacgggaggcagcagtgaggaatattggtcaatggacggtagtctgaaccagccatgccgcgtgcgggaggacggccctatgggttgtaaaccgcttttgagtgagagcaataaggatcatgagtggtccgatgagagtatcattcgaataag

SEQ ID NO: 4496 - DNA, 490 bp, Unknown
  Ascusbbf_1519217, encodes 16S rRNA
agagtttgatcctggctcagaacgaacgctggcggcatgcctaacacatgcaagtcgaacgagaccttcgggtctagtggcgcacgggtgcgtaacacgtgggaacctgcccttaggttcggaataactcaccgaaaggtgtgctaataccggataatgtcttcggaccaaagatttatcgcctttggatgggcccgcgtaggattagctagttggaggggtaacggcccaccaaggcgacgatcagtagccggtctgagaggatgaacggccacattgggactgagacacggcccagactcctacgggaggcagcagtggggaatcttccgcaatggacgaaagtctgacggagcaacgccgcgtgaacgatgacgaccttcgggttgtaaagttctgttatacgggacgaatggcgcaacggtcaatacccgttgcgagtgacggtaccgtaagagaaagccacggctaactacgtgccagcagccgc

SEQ ID NO: 4497 - DNA, 480 bp, Unknown
  Ascusbbf_1606480, encodes 16S rRNA
agagtttgatcctggctcaggatgaacgctggcggcatgcctaatacatgcaagtcgtgcgagaaactaccttagggtggcggaaagcggcggacgggtgagtaacgcgtagaaacataccccaaggtgagggataagcatcggaaacggtgtctaataccgcatactgtctacggacaaaagatttatcgccatgggaatggtctgcgtctgattagctagttggtagggtaaaggcctaccaaggcgatgatcagtagctggtttgagaggatgatcagccacactggaactgagacacggtccagactcctacgggaggcagcagtagggaattttccacaatgggcgaaagcctgatggagcaatgccgcgtgcgggatgaaggttttcggactgtaaaccgcttttatatatgaagattatgacggtaatatatgaataaggatcggctaactacgtgccagcagccgcggtaat

SEQ ID NO: 4498 - DNA, 490 bp, Unknown
  Ascusbbf_1688030, encodes 16S rRNA
agagtttgatcctggctcagaaccaacgctggcggcaggcttaacacatgcaagtcgagcgcctcgcaaggggagcggcagacgggtgagtcacacgtgggaatctacccatccctgcggaacaactccgggaaactggagctaataccgcatacgccctacgggggaaagatttatcggggatggatgagcccgcgttggattagttagttggtgaggtaagggcccaccaagacgatgatgcgtagccggcctgagagggtgaacggccacattgggactgagacacggcccagactcctacgggaggcagcagtggggaatcttccgcaatgggcgaaagcctgacggagcaatgccgcgtgagtgatgaaggaattcgttccgtgaagctcttttgtttatgacgaatgtgcagactgtgaataatggtttgtaatgacggtagtaaacgaataagccacggctaactacgtgccagcagccgcgg

SEQ ID NO: 4499 - DNA, 490 bp, Unknown
  Ascusbbf_1324633, encodes 16S rRNA
agagtttgatcctggctcaggatgaacgctagcggcaggcttaacacatgcgagtcgaggggcagcgcggggtagcaatactctggcggcgaccggcggaagggtgcgtaacgcgtgagcaacttgcccgtcactgggggataggcactggaaacggtgtgtaatactccataacatatggattcacatggatttatattgaaagattcgttggtgacggatggtctcgcgtaacattagctagtcggcggggtaacggcccaccgaggctacgatgtttaggggttctgagaggaaggtcgccgaacctggacctgagacaggatccaggctcctacgggaggaagcagtgaggaatattggtcaatgggcggaagcctgaagcagccatgcagcgtgcaggaataaggccctatgggtcgtaaactgcttttccttgagggcaataagggtcacgtgtggcccgatgagagtatcaggggaataagca

SEQ ID NO: 4500 - DNA, 474 bp, Unknown
  Ascusbbf_1679807, encodes 16S rRNA
agagtttgatcatggctcaggatgaacgctggcggcgtgcctaaggtatgcaagtcgaccggaaacacttcgggtgtcgaggggcggacggctgagtaacacgtaggaatgtaccccagactgagggataagcaccggaaacggtgtctaataccgcataacctcttcggagaaaagcttcggcggtttgggaacagcctgcgcaagaatagcttgttggtgaggtaaaggctcaccaaggcgatgatctttagctggtctgagaggatgatcagccagactgggactgagacacggcccagacccctacggggggcagcaactaggaatcttccacaatggacgaaagtctgatggagcaacgccgcgtgcaggatgaaggccttcgggttgtaaactgcttttttctgtgatgattatgacagtagcagacgaataaggatcggctaactctgtgccagcagccgcggtaat

SEQ ID NO: 4501 - DNA, 186 bp, Unknown
  Ascusbbf_1272836, encodes 16S rRNA
agagtttgatcctggctcagcgcctcccccacgctcttttcacagtgcatcaccgggatgggcaggcccagatcctttaagaaccgggccagggcttccacctgatcgtaccaggaatcgtacatcatgaattccagcccgtcgcagcgcaggtttttcccgcagcccgccagcagccgcggtaat

SEQ ID NO: 4502 - DNA, 490 bp, Unknown
  Ascusbbf_1322620, encodes 16S rRNA
agagtttgatcctggctcaggatgaacgctggcggcgtgcttaacacatgcaagtcgaacggacggtagtaatactgtcagtggcggacgggtgaggaacacgtagctgacctgccttatagtttgggataacgtctcgaaagagacgctaataccggataagctgttgtgtaatagcgatgcaacaggaaaggggaaacccgctaaaagagggggctgcgacctatcaggtagttggtggggtaaaagcctaccaagccgacgacgggtaaggggtctgagaggatgacccctcacactgggactgagacacggcccagactcctacgggaggcagcagtgaggaatattgcacaatgggggaaaccctgatgcagcgacgccgcgtgggtgaagaaggtcttcggatcgtaaagccctttttggcatgacgagagaaggacggtagtgccagaataagcctcggctaactacgtgccagcagccgcgg

SEQ ID NO: 4503 - DNA, 490 bp, Unknown
  Ascusbbf_1252668, encodes 16S rRNA
agagtttgtcctggctcaggatgaacgctagcggcaggcctaacacatgcaagtcgaggggcagcacgtaaagtagtttactacttttggtggcgaccggcgcacgggtgcgtaacgcgtatataacctgcttcgaactgggggataattcggagaaatctggtctaataccctataacatccgggaaggcatcttcctgggttgaaagctccggcggttcgagatggatatgcgtgacattaggtagttggtgaggtaacggctcaccaagcctacgatgtctagggggactgagaggttaaccccccacactggtactgagacacggaccagactcctacgggaggcagcagtgaggaatattggtcaatggacgcaagtctgaaccagccatgccgcgtgcaggaagacggctctatgagttgtaaactgcttttgtataagggtaaacccaggtacgtgtacctggctgaaagtactatacgaata

SEQ ID NO: 4504 - DNA, 182 bp, Unknown
  Ascusbbf_1459649, encodes 16S rRNA
agagtttgatcctggctcagtggtaacgaacccgactagtatccatggggctgtgggttcaatccctggcctcacacagtgggctaaggatctggcactgccatgagcaatggcatagatcacagatgtggctcaaatcccacgttgctgtggttatggtgtaggccagcagccgcggtaat

SEQ ID NO: 4505 - DNA, 395 bp, Unknown
  Ascusbbf_1341638, encodes 16S rRNA
taagcactccgtggacagatttgtcattgtgagcattttcatcccgaagttgcggctcattctgattctgaacagcttcttgggaagtagcgacagcttggtttttagtgagttgttccattctttagctcctagacctttagcagcaaggtccatatctgactttttgttaacgtatttagccacatagaaaccaacagccatataactggtagctttaagcggctcacctttagcatcaacaggccacaaccaaccagaacgtgaacaagcggcctgcgtgtagcgagctgtgatgggcatactggaaccagaataccacggatctcgcgaggcttttaacaggcggcggatgcatacgcgacgaccaaaactaggctcgacgccaccggaag

SEQ ID NO: 4506 - DNA, 490 bp, Unknown
  Ascusbbf_1445370, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttcccctgaggagggcatagcccggcgaaagtcggaggaataccctatgttttccgttgaggacatctgaagtggaacaaagatttatcgctaagggatggggatgcgtcggattaggttggtggcggggtaacggcccaccaagccatcaagcagtaggggttctgagaggaagggccccatcatgcgtactgagccccggcccaaactcctacgggaggcagcagtgacgaatattcgtcactgggcgagagcctgaaccagccaagtagcgtgcaggatgacggccctatgggtggtaaactgcttttgcatgggaataaagtgagggacgtgtccctttttgtatgtaccatgagaat

SEQ ID NO: 4507 - DNA, 490 bp, Unknown
  Ascusbbf_1435666, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtacaacggagagaaatttccactaatcctccatattgttagagattcgcatgtttctctaacgaaagcttcggtggttacggatgggcatacgtgacattagctagttggtagggtaacgccataccaaggcgacgatgtctaggggagctgagaggcttatcccacacacgtgtacggagacacggaccagggtcctacaggaggcagcggtgaggaatgttggtcgatggacggaagactgaaccagccatgcagcgtggaggaagaaggtccgatgggttgtaaaatccttttgttcgagagtaataagaggcttgcgagcatcgatgagagtatcggacggataagc

SEQ ID NO: 4508 - DNA, 490 bp, Unknown
  Ascusbbf_1617010, encodes 16S rRNA
agagtttgatcctggctcaggatgaacgctagcgataggcctaacacatgcaagtcgaggggcagcaaggggtagcaatactctgttggcgaccggcgcacgggtgagtaacgcgtatgcaacctacctactacaggggaataacccggagaaattcggactaataccgcataatacaggggtcccgcatgggaatatttgttaaagatttatcggtagtagatgggcatgcgttccattagccagttggtgaggtaacggctcaccaaagcaacgatggataggggaactgagaggtttatcccccacactggaactgagacacggaccagactcctacgggaggcagcagtgaggaatattggtcaatggacgagagtctgaaccagccaaatcgcgtgaaggaagactgccttatgggttgtaaacttcttttatacaggaataaaaagagttacgtgtaacttattgcatgtactgtatgaataag

SEQ ID NO: 4509 - DNA, 490 bp, Unknown
  Ascusbbf_1445945, encodes 16S rRNA
agagtttgatcctggctcaggataaacgctggcggcgaacataagacatgcaagtcgaacggacggaactcattcgtaacgattgagagcggggaggggcggacgggggaggaagggagaaggaacctgccgatcagaggggaacaacagtgggaaacgactgctaataccgcatatgccacgagaatcacatggttcaagagggaaaggagcaatccgcggatagatggactgatatctgattagctagttggtggggtaacggcctaccaaggcgacgatcagtagccggactgagaggttaaacgtccacattgggactgggctacggccacgactcctacgggaggcagcagtcgggaatattgcgcaatggaggaaactctgacgcagtgccgccgcgtgcaggaagaaggttttcggattgtaaactgctttagacagggaagaaaaaagacagtacctgtagaataagctccggctaactacg

SEQ ID NO: 4510 - DNA, 490 bp, Unknown
  Ascusbbf_1322152, encodes 16S rRNA
agagtttgatcctggctcaggataaacgctggcggcgcacataagacatgcaagtcgaacgaacttaatcgaaagtttacttttgaagcggttagtggcggactggtgagtaacgcgtaagcaatctgcctatcagaggggaataacagcgagaaatcattgctaataccgcataagctgtgagtatcgcatgatacaatagaaaaggagcaatacgctgatagatgagcttgcgactgattagttagttggtggggtaacggcctaccaagacgatgatcagtagccggactgagaggttagacggccacgaagggactgagagagggcgcagtcgggaacatggggcagcaggcgggaatattgcgcaatggaggagactctgacggagtgacgccgcgtgcgggaagaaggtttgcggattgtaaactgctttagatagggaagaaaaaaaatgacggtacctatagaataagcaccggctaactac

SEQ ID NO: 4511 - DNA, 480 bp, Unknown
  Ascusbbf_140793, encodes 16S rRNA
agagtttgatcctggctcagaacgaacgctggcggcatgcctaacacatgcaagtcgaacgagggccccgcttcggtgggaccctagtggcgcacgggtgagtaacgcgtgggaacctgccctgtggtacggaataactccgggaaactggagctaataccgtatgcgtcctgcgggacaaagatttatcgccatgggatgggcccgcgtaggattagcttgttggtggggtaacggcctaccaaggcttcgatccttagctggtctgagaggatgatcagccacactgggactgagacacggcccagactcctacgggaggcagcagtggggaatattggacaatgggcgcaagcctgatccagcaatgccgcgtgagtgatgaaggccttcgggttgtaaagctctttcgcacgcgacgatgatgacggtagcgtgagaagaagccccggctaacttcgtgccagcagccgcggtaat

SEQ ID NO: 4512 - DNA, 490 bp, Unknown
  Ascusbbf_285367, encodes 16S rRNA
agagtttgatcctggctcagaacgaacgctggcggcgtggattaggcatgcaagtcgaacgagaatctagggaatcaagttttcggacaaggttcgctggaggaaagtggcggaagggtgagtacaacatgggcaatccatctccaagttgggtataactccgcgaaagcggggataatcccgaatgtggtgagccggggcatcccggcgaaactaaaggtggggaccgcaaggcctgccgcttggagccgagcccgtgcactatcagcttgttggcgaggtaacggcccaccaaggctatgacggttagctggtctgagaggatggtcagccacactgggactgagatactgcccagactcctacgggaggctgcagtcgagaatcattcgcaatgggcgaaagcctgacggtgcgacgtcgcgtggaggatgaaggtcttcggattgtaaactcctgtcatgtggaataaacggcctctgtgcgaaca

SEQ ID NO: 4513 - DNA, 490 bp, Unknown
  Ascusbbf_124132, encodes 16S rRNA
agagtttgatcatggctcagattgaacgctggcggcatgctttacacatgcaagtcgaacggtaacaggccttcgggtgctgacgagtggcgaacgggtgagtaatgcatcggaacgtgcccagaggtgggggataacgcagcgaaagctgtgctaataccgcatgtgatctgaggatgaaagcgggggaccaagcagcaatgtttggcctcgcgcctctggagcggccgatgtcagattaggtagttggtggggtaaaggcctaccaagccgacgatctgtagctggtctgagaggacgaccagccacactgggactgagacacggcccagactcctacgggaggcagcagtggggaattttggacaatgggcgcaagcctgatccagcaatgccgcgtgcgggaagaaggccttcgggttgtaaaccgcttttgtacggaacgaaaaggctctggctaatacctggggctgatgacggtaccgtaaga

SEQ ID NO: 4514 - DNA, 490 bp, Unknown
  Ascusbbf_180459, encodes 16S rRNA
agagtttgatcctggctcaggattaacgctggcggcgtgcataacacatgcaagtcgaacgatgaaacttagtagacttcttcggaaagacactaagcggattagtggcgaacgggtgagtaacgcgtgagtaacctgccttacacaaggggatagcctttggaaacgaagaataataccctataaaactataaaagcacatgctagaatggtcaaagtgctagcggtgtaagatggacttgcgtctgattagctagttggtgagataaaagctcaccaaggcaacgatcagtagccggcttgagagagtgtacggccacattgggactgagacacggcccagactcctacgggaggcagcagtggggaattttgcacaatgggggaaaccctgatgcagcgacgccgcgtgatttagaaggccttcgggttgtaaaaatcttttgtataggaagaaaatgacagtactatacgaataaggtccggctaa

SEQ ID NO: 4515 - DNA, 490 bp, Unknown
  Ascusbbf_233676, encodes 16S rRNA
agagtttgatcctggctcaggacgaacgctggcggcgcgcctaacacatgcaagtcgaacggagtttgagagagcttgctttttcaaacttagtggcgaacgggtgagtaacgcgtgagtaacctgccctggagtgggggacaacagttggaaacgactgctaataccgcataagcccacagtgccgcatggcacagcgggaaaaggatttattcgcttcaggatggactcgcgtccaattagctagttggtgaggtaacggcccaccaaggcgacgattggtagccggactgagaggttgaacggccacattgggactgagacacggcccagactcctacgggaggcagcagtgggggatattgcacaatgggggaaaccctgatgcagcgacgccgcgtggaggaagaaggttttcggattgtaaactcctgtcgttagggacgataatgacggtacctaacaagaaagcaccggctaactacgtgcc

SEQ ID NO: 4516 - DNA, 490 bp, Unknown
  Ascusbbf_183693, encodes 16S rRNA
agagtttgatcctggctcaggatgaacgctagcggcaggcttaacacatgcaagtcgaggggcagcgcggggtagcaataccctggcggcgaccggcgcacgggtgcgtaacgcgtatgcaacctacctgtgacagggggataacggtgcgaaagcgccactaataccccatattgacggggtcccgcatggggttccgacgaaagctttctgtggtcacggatgggcatgcgtggcattaggtagttggcggggtaacggcccaccaagccgacgatgcctaggggggctgagaggcctgacccccacactggtactgagacacggaccagactcctacgggaggcagcagtgaggaatattggtcaatgggcggaagcctgaaccagccatgccgcgtgagggatggaggccctatgggttgtaaacctcttttagccgggagtaataagggcggtgcgccgtccgatgagagtaccggcggaataag

SEQ ID NO: 4517 - DNA, 490 bp, Unknown
  Ascusbbf_1711763, encodes 16S rRNA
agagtttgatcatggctcagaacgaacgctggcggcaggcctaacacatgcaagtcgagcgtgaaaggggcttcggccctgagtaaagcggcgcacgggtgagtaacacgtgaataatctgcccttgagaccgggataacagaccgaaaggactgctaataccggataagcccacgaatcaaccgggtttgtgagaaaagagcgggaaccttcgggtccgttcacttgaggatgagttcgcgtcccattagatagttggtgaggtaatggctcaccaagtcgacgatgggtagctggtctgagaggatgatcagccacactggaactgagacacggtccagactcctacgggaggcagcagtggggaattttgcgcaatgggggaaaccctgacgcagccatgccgcgtgagtgatgaaggccttcgggttgtaaagctccgtttaaggggacgaacgtccgctgtgacaacaacgcagcggagtgacgg

SEQ ID NO: 4518 - DNA, 486 bp, Unknown
  Ascusbbf_83640, encodes 16S rRNA
agagtttgatcctggctcagaacgaacgctggcggcacgcttaacacatgcaagtcgaacggagttatggggcttgctccataacttagtggcggacgggtgagtaacacgtgggaacatgtccgtttgtggtggatagcttcgggaaactgaagataatacagcataagctcgagagaggaaaggtcgcaagatcgcagacggagtggcccgcggctgattaggtagttggtggggtaatggcctaccaagccaatgatcagtagctggtctgagaggacggacagccacactgaaactgagatacggttcagactcctacgggaggcagcagtggggaatattggacaatgggggcaaccctgatccagcgatgccgcgtgagtgatgaaggtcttaggattgtaaagctcttttgacagggaagataatgacggtacctgtagaataagcaccggctaactctgtgccagcagccgcggtaat

SEQ ID NO: 4519 - DNA, 490 bp, Unknown
  Ascusbbf_491384, encodes 16S rRNA
agagtttgatcctggctcaggacgaacgctggcggcgtgcttcatacatgcaagtcgaacgataaggcgtcttcggacgtacataagtggcggacgggtgagtaatgtgtagataatctgccctagagatggggacaacagttggaaacgactgctaatacccaatatgcgcgtacttgagatagtattcgtgaaaactccggtgctctgggatgagtctgcatctgattagctagttgggggtgtaatggaccaccaaggcgacgatcagtagctggtttgagaggatgatcagccacaatgggactgagacacggcccatactcctacgggaggcagcagtagggaattttgcgcaatggggggaaccctgacgcagcaacgccgcgtgattgatgaagcccttcggggtgtaaagatctgtcagtggggacgaagaatgacggtacccacagaggaagcatcggctaactccgtgccagcagccgcg

SEQ ID NO: 4520 - DNA, 221 bp, Unknown
  Ascusbbf_74946, encodes 16S rRNA
agagtttgatcctggctcaggacgaacgctggcggcgtgcttcatacatgcaagtcgaacgagaagttaccttcgggtaatggacagtggcggacgggtgagtaaaatgtagagaatctgcccttgagatggggacaacagttggaaacgactgctaatacccaatatgcgcgtagttgagatactattcgtgaaaactccgtgccagcagccgcggtaat

SEQ ID NO: 4521 - DNA, 490 bp, Unknown
  Ascusbbf_1444376, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgacattagctagttggtaaggtaacggcttaccaaggcgacgatgtctaggggagctgagaggcttatccccaacacaggtacggagacagcgaacatattcctacgggaggaagccgtgaggaatattggtcaatggacggaagtcggaacaagccatgccgcgtggaggaagaaggtcctatgggttgtaaactccttttgttcgagagtaataagggctttgcgaagcccgatgagagtatcggacgaataagc

SEQ ID NO: 4522 - DNA, 490 bp, Unknown
  Ascusbbf_713855, encodes 16S rRNA
agagtttgatcatggctcaggacgaacgctggcggcgtgcctaacacatgcaagtcgaacgagaatttagcggatgattccttcgggatgaatttgctgaaggaaagtggcggacgggcgagtaacgcgtgaataacctgcccataagagggggataatccgtggaaacgcggactaataccgcatattgagtgattatcgcatggtttttacttgaaagattttatcgcttatggatggattcgcgtcagattagatagttggtgaggtaacggctcaccaagtcaacgatctgtagccgaactgagaggttgatcggccgcattgggactgagacacggcccagactcctacgggaggcagcagtggggaatattgcgcaatgggggaaaccctgacgcagcaacgccgcgtgcaggaagaaggtcttcggattgtaaactgttgtcctctgtgacgataatgacggtagcagaggaggaagccacgg

SEQ ID NO: 4523 - DNA, 490 bp, Unknown
  Ascusbbf_384622, encodes 16S rRNA
agagtttgatcatggctcagattgaacgctggcggcatgccttacacatgcaagtcgaacggcagcggggacttcggtccgccggcgagtggcgaacgggtgagtaaagtatcggaacgtacctttcagtgggggataacgtagcgaaagttacgctaataccgcatattctgtgagcaggaaagcaggggatcgcaagaccttgcgctgattgagcggccgatatcagattagctagttggtggggtaaaggcctaccaaggcgacgatctgtagcgggtctgagaggatgatccgccacactggaactgagacacggtccagactcctacgggaggcagcagtggggaattttggacaatgggggcaaccctgatccagccatgccgcgtgagtgaagaaggccttcgggttgtaaagctctttcggccgggaagaaatcgcgcaggctaataccctgtgtggatgacggtaccggaataagaagcac

SEQ ID NO: 4524 - DNA, 490 bp, Unknown
  Ascusbbf_102375, encodes 16S rRNA
agagtttgatcatggctcaggacgaacgctggcggcgtgcctaacacatgcaagtcgaacggacttaaggagcttgctctttaagttagtggcggacgggtgagtaacgcgtgagcaacctgccttacagagggggataacgtttggaaacgaacgctaataccgcataagatggagaagtcgcatggctttttcaccaaaggagtaacatccgctgtaagatgggctcgcgtccgattagatagttggcggggtaacggcccaccaagtcgacgatcggtagccggactgagaggttgaacggccacattgggactgagacacggcccagactcctgcgggaggcagcagtgagggatattgcacaatgggcgaaagcctgatgcagcaacgccgcgtgagtgatgacggtcttcggattgtaaagctctgttcttggtgaagataatgactttagccaaggagaaagccacggctaactacgtgccag

SEQ ID NO: 4525 - DNA, 490 bp, Unknown
  Ascusbbf_143170, encodes 16S rRNA
agagtttgatcatggctcaggacgaacgctggcggcgcgcctaacacatgcaagtcgaacggtttcatattgagcttgcttgatatgagatagtggcggacgggtgagtaacacgtgagcaacctggctataggagggggatagcgtctggaaacggacggtaataccgcatgatatctagataaggcatcttagatagatcaaagggaggagactctgccgatagatgggctcgcgactgattaggtagttggtgtggtaacggcataccaagccgatgatcagtagccggactgagaggttgaacggccacattgggactgagatacggcccagactcctacgggaggcagcagtgggggatattgcacaatggagggaactctgatgcagcgacgccgcgtgagggaagacggttttcggattgtaaacctctgtcttatgggaagaagaggatgacggtaccataagaggaagccacggctaacta

SEQ ID NO: 4526 - DNA, 490 bp, Unknown
  Ascusbbf_445636, encodes 16S rRNA
agagtttgatcctggctcagaacgaacgctggcggcgtgcctaacacatgcaagtcgcgcgcgaagggcttcggccttgtagagcggcgcacgggtgagtaacacgtgggtaatctacccttaggtctggaataactcagggaaacttgagctaataccggataagaccacgagacgaaggtcttgtgggaaaagtggaggatctcttcggagacttcgcgccaaaggatgagcccgcgtcccatcaggtagttggcggggtaacggcccaccaagcctaagacgggtagctggtctgagaggatgatcagccacactggaactgagacacggtccagactcctacgggaggcagcagtggggaatcttgcgcaatggacgaaagtctgacgcagcaacgccgcgtgagtgatgaaggtcttcggatcgtaaagctctgtcggcaggaacgatggatagtgtggataacacctacgctatctgacggtac

SEQ ID NO: 4527 - DNA, 490 bp, Unknown
  Ascusbbf_536154, encodes 16S rRNA
agagtttgatcctggctcaggacgaacgctggcggcgcgcctaacacatgcaagtcgaacggagcttttcagagcttgctttgaaaagcttagtggcgaacgggtgagtaacgcgtgagtaacctgccctcgagtgggggacaacagttggaaacgactgctaataccgcataagaccacggagccgcatggctcaggggtaaaaggatttattcgcttgaggatggactcgcgtccaattagctagttggtgaggtaacggcccaccaaggcgacgattggtagccggactgagaggttgatcggccacattgggactgagacacggcccagactcctacgggaggcagcagtgggggatattgcacaatgggggaaaccctgatgcagcgacgccgcgtgaaggaagaaggccttcgggttgtaaacttctgtcgtacgggacgataatgacggtaccgtacaagaaagccacggctaactacgtgcc

SEQ ID NO: 4528 - DNA, 153 bp, Unknown
  Ascusbbf_50031, encodes 16S rRNA
agagtttgatcctggctcaggacgaagtgaagaaggttttcggatcgtaaaactctgttgttagagaagaacaaggatgagagtaactgttcatcccttgacggtatctaaccagaaagccacggctaactacgtgccagcagccgcggtaat

SEQ ID NO: 4529 - DNA, 490 bp, Unknown
  Ascusbbf_400565, encodes 16S rRNA
agagtttgatcatggctcaggacgaacgctggcggcacgcttaacacatgcaagtcgaacggagttgtattagcttgctaatataacttagtggcggacgggtgagtaacacgtgagcaacctgccttcgagagtggaataatgtctggaaacggacactaataccgcatgacatacaggattcgcatgttttctgtatcaaagatttatcgctcgaagatgggctcgcgtccgattagctggttggtgaggtaacggctcaccaaggcgacgatcggtagccgtactgagaggtagaacggccacattgggactgagacacggcccagactcctacgggaggcagcagtggggaatattgcacaatggaggaaactctgatgcagcgatgccgcgtgagggaagaaggcatttttgttgtaaacctctgttatcagggacgataatgacggtacctgaggaggaagctccggctaactacgtgccagca

SEQ ID NO: 4530 - DNA, 311 bp, Unknown
  Ascusbbf_701892, encodes 16S rRNA
agagtttgatcatggctcagattgaacgctggcggcaggcttaacacatgcaaccgatgatctctagctggtttgagaggacaatcagccacattggaattgagaaacggaccaaactcctacgggaggcagcagtggggaatattgcacaatgggggaaaccctgatgcagccatgccacgtgtgtgaagaaggccttcgggttgtaaagcacttttgcattcgaggaagacggcgtataaataaatgcgctatttgacgttagagtgtgaataagcaccggcaaactccgtgccagcagccgcggtaat

SEQ ID NO: 4531 - DNA, 490 bp, Unknown
  Ascusbbf_457753, encodes 16S rRNA
agagtttgatcatggctcaggacgaacgctggcggcgtgcctaacacatgcaagtcgaacgagaatctgcggacggaggcttcggccaactgaaacagaggaaagtggcgaacgggtgagtaacgcgtgaggaacctgcctcggagtgggggacaacagttggaaacgactgctaataccgcataatatgcctgaaggacatccttccgggcatcaaagctttatgtgctctgagatggcctcgcgtctgattagatagttggcggggtaacggcccaccaagtcgacgatcagtagccggtctgagaggatgaacggccacattgggactgagatacggcccagactcctacgggaggcagcagtggggaatattgggcaatgggcgaaagcctgacccagcaacgccgcgtgaaggaagaaggctttcgggttgtaaacttcttttaccagggacgaaggacgtgacggtacctggagaaaaagccac

SEQ ID NO: 4532 - DNA, 490 bp, Unknown
  Ascusbbf_205648, encodes 16S rRNA
agagtttgatcatggctcaggacgaacgctggcggcacgcttaacacatgcaagtcgaacggagttattgagagcttgctttcgataacttagtggcggacgggtgagtaacacgtgagcaacctgccttcaagagcggaatagcttctggaaacggatggtaataccgcataacattacgttaccgcatggtagtgtaatcaaagatttatcgcttgaagatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggcgcaagcctgatgcagcgatgccgcgtggaggaagaaggttttcggattgtaaactccttatctgagggacgataatgacggtacctcaggagaaagctccggctaactacgtgccag

SEQ ID NO: 4533 - DNA, 485 bp, Unknown
  Ascusbbf_220826, encodes 16S rRNA
agagtttgatcctggctcaggataaacgctggcggcgtgcctaatgcatgcaagtcgaacgatccttcgggatagtggcagacgggtgagtaacgcgtaagtgacctgtccgtgagtggggaataactgcccgaaagggtagctaattccgcataatgtcgccggttgaatgccggacgaccaaaggagaaatccgctcgtggaggggcttgcgtccgattagctagttggtggggtaaaggcctaccaaggcgatgatcggtagctggtctgagaggacgatcagccacacggggactgagacacggccccgactcctacgggaggcagcagcaaggaattttgcgcaatgggcgaaagcctgacgcagcaacgccgcgtgggggaagaatgccttcgggttgtaaactccttttctcagggaagatagtgacggtacctgaggaataagtctcggctaactacgtgccagcagccgcggtaat

SEQ ID NO: 4534 - DNA, 490 bp, Unknown
  Ascusbbf_396318, encodes 16S rRNA
agagtttgatcctggctcagattgaacgctggcggcatgctttacacatgcaagtcgaacggcagcggggaggagcttgcttctctgccggcgagtggcgaacgggtgagtaatacatcggaacgtgtcgagaagagggggataaccacccgaaagggtggctaataccgcataaattctgaggaagaaagctggggacctgggaataggcctagcgctttttgagcggccgatgtcggattagctagttggtgaggtaaaggctcaccaaggcgaagatctgtagcgggtctgagaggatgatccgccacactgggactgagacacggcccagactcctacgggaggcagcagtggggaattttggacaatgggggcaaccctgatccagccatgccgcgtgtatgaagaaggccttagggttgtaaagtacttttgttagggaagaaaagtcagctgtgaataatggctgatactgacggtacctaaa

SEQ ID NO: 4535 - DNA, 483 bp, Unknown
  Ascusbbf_306974, encodes 16S rRNA
agagtttgatcctggctcagaacgaacgttggcggcgtggattaggcatgcaagtcgcgggaatgcccagcaatgggtggaaccggcgtaaggggcagtaaggcatgggtacctacctggaggttgggcatagcccgtagaaatacggggtaattcccagcgatgtcgaaagaccaaagctccggcgcctcttgaggggcccatgtgatattagctagttggtgaggtaacggctcaccaaggcgaagatgtctagcgggtgtgagagcacgacccgcgccactggcactgagacactggccagacacctacgggtggctgcagtcgagaatcttcggcaatgggcgcaagcctgaccgagcgacgccgcgtgtgcgatgaaggccttcgggttgtaaagcactgtcgagagggagaaaggcgaaagcttgatctatctctggaggaagcacgggctaagttcgtgccagcagccgcggtaat

SEQ ID NO: 4536 - DNA, 490 bp, Unknown
  Ascusbbf_422699, encodes 16S rRNA
agagtttgatcctggctcaggacgaacgctggcggcgcgcctaacacatgcaagtcgaacggagtttgtttgaaagatcccttcggggtgactttggataaacttagtggcgaacgggtgagtaacacgtgaggaacctgcccttcagagggggacaacagttggaaacgactgctaataccgcataagaccacagagccgcatggctcaggggtcaaaggagaaatccgctgaaggatggcctcgcgtccgattagctggatggcggggtaacggcccaccatggcgacgatcggtagccggactgagaggttgaacggccacattgggactgagacacggcccagactcctacgggaggcagcagtggggaatattgcacaatgggggaaaccctgatgcagcgacgccgcgtgagggaagaagattttcggattgtaaacctctgtcttcagggacgataatgacggtacctgaggaggaagccacg

SEQ ID NO: 4537 - DNA, 490 bp, Unknown
  Ascusbbf_1878775, encodes 16S rRNA
agagtttgatcatggctcaggacgaacgctagcggcgcgcttaacacacgcaagtcgagcggaaaggcccttcggggtactcgagcggcgaacgggtgagtaacacgtgagcaacctgcccttggctttgggataaccccgggaaaccggggctaataccgaatacccacgcaccgtcgcatgacggtgcgtgaaaagttcttcggttgaggatgggctcgcggcctatcagcttgttggtggggtaacggcctaccaaggcttcgacgggtagccggcctgagagggcgaccggccacactgggactgagatacggcccagactcctacgggaggcagcagtgggaatattgcacaatgggcgcaagcctgatgcagcgacgccgcgtgagggacgaaggccttcgggttgtaaacctctttcggcagggacgaagcgaaagtgacggtacctgaagaagaagcgccggccaactacgtgccagcagcc

SEQ ID NO: 4538 - DNA, 490 bp, Unknown
  Ascusbbf_405735, encodes 16S rRNA
agagtttgatcatggctcagattgaacgctggcggcaggcctaacacatgcaagtcgagcgcgaaaattccttcggggatgagtagagcggcggacgggtgagtaatgcgcagaaatctgcccagtagtgggggacaacctggtgaaaaccaggctaataccgcatacgccctacgggggaaagcaggggatcttcggaccttgcgctattggatgagtctgcgtcggattagcttgttggtgaggtaatggctcaccaaggcgacgatccgtagctggtctgagaggatgatcagccacactgggactgagacacggcccagactcctacgggaggcagcagtggggaatattggacaatgggcgaaagcctgatccagccatgccgcgtgtgtgaagaaggctctagggttgtaaagcactttcagtggggaagaaagcttgttagcgaataactgacgagtgtgacattacccacagaagaagcacc

SEQ ID NO: 4539 - DNA, 490 bp, Unknown
  Ascusbbf_418703, encodes 16S rRNA
agagtttgatcatggctcaggacgaacgctggcggcgtgcctaacacatgcaagtcgaacgaagctccaatctttgagattcgtcaagaagagaggatgacttagtggcggacgggtgagtaacgcgtgagcaacctgcctttcagtgggggacaacagagggaaacttctgctaataccgcataatgtgccggggggacatcctcctggtaccaaagatttatcgctgaaagatgggctcgcgtctgattagatagttggtggggtaacggcccaccaagtcgacgatcagtagccgggttgagagactgaccggccacattgggactgagatacggcccagactcctacgggaggcagcagtggggaatattgggcaatgggggaaaccctgacccagcaacgccgcgtgaaggaagaaggccctcgggttgtaaacttcttttaccagggacgaagaaagtgacggtacctggagaaaaagctccgg

SEQ ID NO: 4540 - DNA, 490 bp, Unknown
  Ascusbbf_930558, encodes 16S rRNA
agagtttgatcatggctcagattgaacgctggcggcatgcttaacacatgcaagtcgaacggcagcacagcagagcttgctctgtgggtggcgagtggcggacgggtgagtaatgcatcgggacctacccagacgtgggggataatgtagggaaacttacgctaataccgcatacgtcctacgggagaaagcgggggatcttcggacctcgcgcggttggatggaccgatgtgcgattagctagttggtgaggtaacggctcaccaaggcgacgatcgctagctggtctgagaggatgatcagccacactgggactgagacacggcccagactcctacgggaggcagcagtggggaatattggacaatgggcgcaagcctgatccagcaatgccgcgtgtgtgaagaaggccttcgggttgtaaagcacttttatcaggagcgaaatctgcaaggttaatacctttgcagtctgacggtacctgaggaat

SEQ ID NO: 4541 - DNA, 490 bp, Unknown
  Ascusbbf_1787362, encodes 16S rRNA
agagtttgatcatggctcaggataaacgctagcggcaggcctaacacatgcaagtcgagcggcagcgcggagtggcaacactttggcggcgagcggcggacgggtgagtaacgcatatgcaacctgcccaccacacggagatagccgaccgaaaggacgattaaactccgatggcatcatacccccgcatggaggtttgattaaatatttataggtggtggatgggcatgcgtggcattagttagttggcggggcaacggcccaccaagacgattatgcctatgggttctaaaaggaagatcccacacatcggtactgagacacggaccgaactcctacgggaggcagcagtgaggaatattggacaatgggggcaaccctgatccagccgaaccgcgtggtggaaggaggtcgttaagatcgtaaacaccttttatatgggaataatacacatcacgagtggtgtgttgaatgtaccatttgaataagc

SEQ ID NO: 4542 - DNA, 490 bp, Unknown
  Ascusbbf_819591, encodes 16S rRNA
agagtttgatcctggctcaggacgaacgctagcggcgtgcctaatacatgcaagtcgagcgaagtttttctggtgcttgcactagaaaaacttagcggcgaacgggtgagtaacacgtaaagaacctgcctcatagactgggacaactattggaaacgatagctaataccggataacagcattaactgcatggttgatgtttgaaagttggttttgctaacactatgagatggctttgcggtgcattagctagttggtggggtaaaggcctaccaaggcgacgatgcatagccgacctgagagggtgatcggccacactgggactgagacacggcccagactcctacgggaggcagcagtagggaatcttccgcaatgggcgaaagcctgacggagcaacgccgcgtgagcgaagaaggatttcggttcgtaaagctctgttgttagggaggaatgattatgtagtaactatacatagtagagacggtac

SEQ ID NO: 4543 - DNA, 490 bp, Unknown
  Ascusbbf_269135, encodes 16S rRNA
agagtttgatcctggctcaggatgaacgctggcggcgtgcctaacacatgcaagtcgaacggttaaaaccacttcggtggcgtatagagtggcgaacgggtgagtaacacgtgaccaacctgccccccgcaccgggacaacgggtggaaacgcctgctaataccggatactccggggacggcgcatgccggccccgggaaagctccggcggcgggggatggggtcgcggcccatcagctagacggcggggtgacggcccaccgtggcgactacgggtagccgggttgagagaccgaccggccacattgggactgagacacggcccagactcctacgggaggcagcagtggggaatattgcgcaatgggggcaaccctgacgcagcaacgccgcgtgcgggacgaaggccttcgggtcgtaaaccgctttcatcggggaagacatcgactgtacccgaggaagaagccccggctaaatacgtgccagcagc

SEQ ID NO: 4544 - DNA, 248 bp, Unknown
  Ascusbbf_321173, encodes 16S rRNA
agagtttgatcctggctcaggatgaacgctagctacaggcttaacacatgcaagtcgaggggtaacgatattgaaagcttgctttcgataggcgacgaccggcgcacgggtgagtaacgcgtatccaacctgcccataactaagggataatccgtagaaatgcggtctaataccttatgtgttccgaagaagacgacggtacctgactaagaagccccggctaactacgtgccagcagccgcggtaat

SEQ ID NO: 4545 - DNA, 490 bp, Unknown
  Ascusbbf_1076004, encodes 16S rRNA
agagtttgatcctggctcaggatgaacgctagcggcaggcctaatacatgcaagtcgaacgggatccagttgttagcttgctaacaactggtgagagtggcgcacgggtgcgtaacgcgtgagcaacctacccatatcagggggatagcccgaagaaattcggattaacaccgcataagactacgagatggcatcatcaagtagttaaatatttataggatgtggatgggctcgcgtgacattagctagttggtgaggtaacggctcaccaaggcgacgatgtctaggggctctgagaggggaatcccccacactggtactgagacacggaccagactcctacgggaggcagcagtaaggaatattggtcaatggacggaagtctgaaccagccatgccgcgtgcaggatgactgccctatgggttgtaaactgcttttgtcgaggaataaacctatctacgtgtagatagctgaatgtacccgaagaat

SEQ ID NO: 4546 - DNA, 490 bp, Unknown
  Ascusbbf_890538, encodes 16S rRNA
agagtttgatcatggctcaggacgaacgctggcggcgtgcctaacacatgcaagtcgagcgagaatttacgaaatgatttcttcggaatgaattttgtaaaggaaagcggcggacgggtgagtaacgcgtgagtaacctgcccataagagtgggataatccatggaaacgtggactaataccgcatattgagataatctcgcatggggatatcttgaaagatttatcgcttatggatggactcgcgtcagattagatagttggtgaggtaacggcccaccaagtcgacgatctgtagccgaactgagaggttgatcggccacattgggactgagacacggcccagactcctacgggaggcagcagtggggaatattgcgcaatgggggcaaccctgacgcagcaacgccgcgtgaaggaagaaggccttcgggttgtaaacttctgtctttagggaagaaacaaatgacggtacctaaggaggaagccac

SEQ ID NO: 4547 - DNA, 473 bp, Unknown
  Ascusbbf_1767099, encodes 16S rRNA
agagtttgatcatggctcagagcgaacgctggcggcaggcttaacacatgcaagtcgagcgggcatccttgtggtgtcagcggcagacgggtgagtaacgcgtgggaacgtgcccttcggttcggaataactcagggaaacttgagctaataccggatacgcccttttggggaaaggtttactgccgaaggatcggcccgcgtctgattagctagttggtgaggttatggctcaccaaggcgacgatcagtagctggtctgagaggatgatcagccacactgggactgagacacggctcagactcctacgggaggcagcagtggggaatattggacaatgggggcaaccctgatccagccatgccgcgtgagtgatgacggccttagggttgtaaagctcttttctccgggacgataatgacggtaccggaggaataagccccggctaacttcgtgccagcagccgcggtaat

SEQ ID NO: 4548 - DNA, 490 bp, Unknown
  Ascusbbf_1115337, encodes 16S rRNA
agagtttgatcatggctcaggatgaacgctggcggcgtgcttaacacatgcaagtcgaacgaagctccggaagcagaggtttcggccaaagcggaaggaagacttagtggcggacgggtgagtaacgcgtgggtaacctgccatatacagggggataacagttagaaatgactgctaataccgcataagcgcacggtaaggcatcttacagtgtgaaaagctcagacggtatatgatggacccgcgtctgattagctagttggaagggtaacggcctaccaaggcgacgatcagtagccggcctgagagggtgaacggccacattgggactgagacacggcccaaactcctacgggaggcagcagtggggaatattgcacaatgggggaaaccctgatgcagcgacgccgcgtgagtgaagaagtacttcggtacgtaaagctctatcagcagggaagaaaatgacggtacctgactaagaagccccggc

SEQ ID NO: 4549 - DNA, 490 bp, Unknown
  Ascusbbf_715867, encodes 16S rRNA
agagtttgatcatggctcaggacgaacgctggcggcgtgcctaatacatgcaagtcgagcgagtctcttcggaggctagcggcggacgggtgagtaacacgtaggcaacctgcccgtaagactgggataacatagggaaacttatgctaataccagatagagtctactctcgcatgagggaagacggaaaggtggcgcaagctatcacttacggatgggcctgcggcgcattagctagttggtggggtaatggcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggtcttcggattgtaaagttctgttgttagggacgaacaagtaccgttcgaacagggcggtaccttgacggtacctgacgagaaagcc

SEQ ID NO: 4550 - DNA, 490 bp, Unknown
  Ascusbbf_372703, encodes 16S rRNA
agagtttgatcatggctcaggatgaacgctggcggcgtgcttaacacatgcaagtcgaacggagaacctcagatcgagttttcggacaagagatgggaattcttagtggcggacgggtgagtaacgcgtgaggaacctgccttggagaggggaataacacagagaaatttgtgctaataccgcatgatgcaactaagtcgcatggctttggttgccaaagatttatcgctctgagatggcctcgcgtctgattagcttgttggcggggtaacggcccatcaaggcgacgatcagtagccggactgagaggttggccggccacattgggactgagacacggcccagactcctacgggaggcagcagtggggaatattgggcaatgggcgcaagcctgacccagcaacgccgcgtgaaggaagaaggctttcgggttgtaaacttcttttgtctgggacgaaagcaatgacggtaccagacgaataagctcc

SEQ ID NO: 4551 - DNA, 241 bp, Unknown
  Ascusbbf_632733, encodes 16S rRNA
agagtttgatcctggctcaggatgaacgctagctacaggcttaacacatgcaagtcgaggaggcagcagtgaggaatattggtcaatggacgagagtctgaaccagccaagtagcgtgcaggatgactgccctatgggttgtaaactgcttttatgcgggaataaagtcaggtacgcgtacctgtttgtatgtaccgcatgaataaggaccggctaattccgtgccagcagccgcggtaat

SEQ ID NO: 4552 - DNA, 490 bp, Unknown
  Ascusbbf_417327, encodes 16S rRNA
agagtttgatcatggctcaggacgaacgctggcggcgtgcttaacacatgcaagtcgaacggaaaggcccgcttgcgggtactcgagtggcgaacgggtgagtaacacgtgggcaacctgccctcagctctgggataactccgggaaaccggtgctaatactggatatcgacttctgcctcgcatggggtgttgttgaaagtttttcggctggggatgggcccgcggcctatcagcttgttggtggggtgatggcctaccaaggcgacgacgggtagccggcctgagagggcgaccggccacactgggactgagacacggcccagactcctacgggaggcagcagtggggaatattgcgcaatgggcggaagcctgacgcagcgacgccgcgtgagggatgacggccttcgggttgtaaacctctttcagctctgacgaagcgagagtgacggtaggagcagaagaagcaccggccaactacgtgccagc

SEQ ID NO: 4553 - DNA, 490 bp, Unknown
  Ascusbbf_1692421, encodes 16S rRNA
agagtttgatcatggctcagattgaacgctggcggcaggcctaacacatgcaagtcgagcggtaacaggagagcttgctctcgctgacgagcggcggacgggtgagtaatgcgcaggaatctacccagtagcgggggatagcccggggaaactcggattaataccgcatacgccctacgggggaaagcaggggatcttcggaccttgcactattggaagagcctgcgttggattagctagttggtagggtaaaggcctaccaaggcgacgatccataactggtctgagaggatgatcagtcaaaccggaactgagacacggtccggactcctacgggaggcagcagtggggaatattggacaatgggggcaaccctgatccagccatgccgcgtgtgtgaagaaggccttcgggttgtaaagcactttaagttgggaggaaggggtgactactaatattagtcatcattgacgttaccaacagaataagc

SEQ ID NO: 4554 - DNA, 487 bp, Unknown
  Ascusbbf_366027, encodes 16S rRNA
agagtttgatcctggctcaggatgaacgctggcggcgtgcctaacacatgcaagtcgagcgatctcttcggagagagcggcggacgggtgagtaacgcgtgggtaacctgccctgtacacacggataacataccgaaaggtatactaatacgggataacatacgaaagtcgcatggcttttgtatcaaagctccggcggtacaggatggacccgcgtctgattagctagttggtaaggtaatggcttaccaaggcaacgatcagtagccgacctgagagggtgatcggccacactggaactgagacacggtccagactcctacgggaggcagcagtggggaatattgcacaatgggcgaaagcctgatgcagcaacgccgcgtgagcgatgaaggccttcgggtcgtaaagctctgtcctcaaggaagataatgacggtacttgaggaggaagccccggctaactacgtgccagcagccgcggtaat

SEQ ID NO: 4555 - DNA, 490 bp, Unknown
  Ascusbbf_488529, encodes 16S rRNA
agagtttgatcctggctcaggacaaacgctggcggcgtgcctaatacatgcaagtctaacgagaaacaggagcttgctcctgtggaaagtggcggacgggtgagtaatatgtaggaaatctgcccttaggtgggggacaacagttggaaacgactgctaataccgcatatgtgcttggttgaaataccaatcatgaaagatttattgcctgaggatgagcctgcatctgattagcttgttggtggtgtaaaggactaccaaggcgacgatcagtagctggtttgagaggatgatcagccaaaatgggactgagacacggcccatactcctacgggaggcagcagtagggaattttgcgcaatgggcgaaagcctgacgcagcaacgccgcgtgagcgatgaagcccctcggggtgtaaagctctgtcagtagggatgaattttgaccgtacctacagaggaagcatcggctaactacgtgccagcagccg

SEQ ID NO: 4556 - DNA, 490 bp, Unknown
  Ascusbbf_477276, encodes 16S rRNA
agagtttgatcctggctcaggacgaacgctggcggcacgcttaacacatgcaagtcgaacgaacgaagaggagcttgctcctcctagttagtggcggacgggtgagtaacacgtgagcaacctgccttcaagtgaggaataatggttggaaacgaccactaatacctcataatgcagcggtatcgcatggtactgctgccaaagcctagtgtgcttgaagatgggctcgcgtccgattagttagatggtgaggtaacggctcaccatgaccgcgatcggtagccgtactgagaggtagaacggccacattgggactgagacacggcccagactcctacgggaggcagcagtggggaatattgcacaatggaggaaactctgatgcagcgatgccgcgtgagggaagaaggctctcgggttgtaaacctctgttcttggggacgataatgacggtacccaaggagaaagctccggctaactacgtgccagc

SEQ ID NO: 4557 - DNA, 490 bp, Unknown
  Ascusbbf_1520504, encodes 16S rRNA
agagtttgatcatggctcaggatgaacgctagcggcaggcctaatacatgcaagtcgaacggtaaatgtcccttcggggatatgagagtggcgcacgggtgcgtaacgcgtatgcaacccacccgctgtcgggggatagcccgtagaaatgcgaattaataccccatgaggagaaagggcggcatcgtccttttttcaaaactttggtgacggcggacgggcatgcgtgccattagatagttggtgaggtaacggcccaccaagtcgacgatggctaggggttctgagaggaaggtcccccacattggaactgagacacggtccagactcctacgggaggcagcagtgaggaatattggacaatggccgagaggctgatccagccatgccgcgtgcgggatgaaggccctatgggtcgtaaaccgcttttgtcggggagcaataagggttacgtgtagcccgatgagagtacctggcgaataagcatcgg

SEQ ID NO: 4558 - DNA, 490 bp, Unknown
  Ascusbbf_654410, encodes 16S rRNA
agagtttgatcctggctcaggatgaacgctggcggcgtgcttaacacatgcaagtcgagcggtaaggccctttcgggggtacacgagcggcgaacgggtgagtaacacgtgagtaatctgccctgcgcttcgggataaccatcggaaacggtggctaataccggatatgacgccctgctgcatggtagggtgtggaaagttttttcggcgcaggatgtgctcgcggcctatcagcttgttggtgaggtaatggctcaccaaggcttcgacgggtagccggcctgagagggtgaccggccacactgggactgagacacggcccagactcctacgggaggcagcagtggggaatattggacaatgggcggaagcctgatccagcaacgccgcgtgagggatgactgccttcgggttgtaaacctctttcagtaccgacgaagcgagagtgacggtaggtacagaagaagcaccggccaactacgtgccagca

SEQ ID NO: 4559 - DNA, 473 bp, Unknown
  Ascusbbf_1821740, encodes 16S rRNA
agagtttgatcatggctcagaacgaacgctggcggcaggcctaaaacatgcaagttgaacgggcgtagcaatacgtttagtagcggacgggtgaggaacatatgggaacgtaccctttggtgggggataacttctggaaacgggaggtaataccgcataagccatgagtgggaaatatttatagccgaaggagcggcccatattggattagctagttggttaggtaaaggctgaccaaggcgacgatccatagccggtttgagaggatgatcggccacactgggactgagacacggcccagactcctacgggaggcagcagttaagaatattggacaatgggggaaaccttgatccagccatgccgcgtgagtgaagaaggccttcgggttgtaaagctcttttgtatgggaaaatgatgatggtaccataagaataagcaccggcaaacttcgtgccagcagccgcggtaat

SEQ ID NO: 4560 - DNA, 490 bp, Unknown
  Ascusbbf_762164, encodes 16S rRNA
agagtttgatcctggctcaggacgaacgctggcggcacgcttaacacatgcaagtcgaacggtgaagtaacttcggttatgggacagtggcggacgggtgagtaacacgtgagcaatctgcctttaagtggggaataacatttggaaacggatggtaataccgcataatatagacatatcgcatgataagtctatcaaagatttatcgcttaaagatgagctcgcgtctgattagatagttggtgaggtaacggctcaccaagtcaacgatcagtagccggactgagaggttgaacggccacattgggactgagacacggcccagactcctacgggaggcagcagtggggaatattgcacaatggaggaaactctgatgcagcgatgccgcgtgagggaagaaggttttcggattgtaaacctctgttgacagggacgataatgacggtacctgttcagaaagctccggctaactacgtgccagcagccg

SEQ ID NO: 4561 - DNA, 490 bp, Unknown
  Ascusbbf_1574432, encodes 16S rRNA
agagtttgatcatggctcaggatgaacgctagcggcaggcctaatacatgcaagtcgaacggtatccccctttcgggggggagagagtggcggatgggtgcgtaacgcgtatgcaacctgcccccttcaggggaatagctcccggaaacgggaatcaataccccatgttcccatatgccggcatcggtttatgggcaaagccttcgggcggtaggggatgggcatgcgtaggattagcttgttggcggtgtaacggaccaccaaggcgacgatccttaggggttctgagaggaaggtcccccacactggcactgagacacgggccagactcctacgggaggcagcagtagggaatattgggcaatgggcggcagcctgacccagccatgccgcgtgcaggaagacggcgttctgcgttgtaaactgcttttacacgggaagaaaaggcccatgcgtgggacattgccggtaccgtgtgaataagcaccgg

SEQ ID NO: 4562 - DNA, 470 bp, Unknown
  Ascusbbf_957621, encodes 16S rRNA
agagtttgatcctggctcagaacgaacgctggcggcatgcctaacacatgcaagtcgaacgagctcttcggagctagtggcggacgggtgagtaacgcgtgggaacctgcccaaaggtaagggataacttcgggaaaccggagctaataccatatacgcccttcgggggaaagatttatcgcctttggatgggcccgcgtcggattagctagttggtggggtaatggcctaccaaggcgacgatccgtagctggtctgagaggatgatcagccacactgggactgagacacggcccagactcctacgggaggcagcagtggggaatattggacaatgggggaaaccctgatccagcaatgccgcgtgtgtgtagaaggccctagggttgtaaagcactttcagcagggaagataatgacggtacctgcagaagaagccccggctaactccgtgccagcagccgcggtaat

SEQ ID NO: 4563 - DNA, 490 bp, Unknown
  Ascusbbf_1071510, encodes 16S rRNA
agagtttgatcctggctcaggataaacgctggcggcgtgcctaatacatgcaagtcgatcggtagaagtccagcttgctggacggaaatagaggcgaacgggtgagtaatacgtaagcaacctgcccacgaagaccgggataatccctggaaacggggactaagaccggataggtacacagaccgcatggtctgtgtattaaaggagagagacactggtggatgggcttacggtgcattagctggatggtgaggtaaggcccaccatggcgatgatgcatagccgggctgagaggctgaacggccacattgggactgagacacggcccagactcctacgggaggcagcagtagggaattttcggcaatgggggcaaccctgaccgagcaacgccgcgtgagtgatgaaggtcttcggattgtaaagctctgttgtaagggaagaacggcatctagagaataggtgagtgacggtaccttaccagaaagct

SEQ ID NO: 4564 - DNA, 490 bp, Unknown
  Ascusbbf_988679, encodes 16S rRNA
agagtttgatcctggctcaggacgaacgctggcggcacgcttaacacatgcaagtcgaacggacgagaaggagcttgcttcttcaagttagtggcggacgggtgagtaacacgtgagcaacctgcctttaagttcgggatagcttctggaaacggatggtaataccggataacatacctgcatcgcatggtgaaggtatcaaagatttattgcttagagatgggctcgcgtctgattagatagttggtgaggtaacggctcaccaagtcgacgatcagtagccggactgagaggttgaacggccacattgggactgagacacggcacagactcctacgggaggcagcagtggggaatattgcacaatgggggaaaccctgatgcagcgatgccgcgtggaggaagaaggttttcggattgtaaactccttttaacggggacgataatgacggtacccgcagaaaaagctccggctaactacgtgccagca

SEQ ID NO: 4565 - DNA, 490 bp, Unknown
  Ascusbbf_1832081, encodes 16S rRNA
agagtttgatcctggctcaggatgaacgctggcggcgtgcttaacacatgcaagtcgaacggagcttataaagaaagcggagcttgctccaatggaagtatgagcttagtggcggacgggtgagtaacgcgtgggtaacctgccttacacagggggacaacagttagaaatgactgctaataccgcataagccggtaggatcgcatgatccatccggaaaagatttatcggtgtaagatgggcccgcgttggattagttagttggtggggtaagggcccaccaagaccgcgatccatagccgacctgagagggtgatcggccacattgggactgagacacggcccaaactcctacgggaggcagcagtggggaatattgcgcaatggggggaaccctgacgcagcaacgccgcgtgagtgaagaagtatttcggtatgtaaagctctatcagcagggaagaagatgacggtacctgcagaagaagtcccg

SEQ ID NO: 4566 - DNA, 490 bp, Unknown
  Ascusbbf_462184, encodes 16S rRNA
agagtttgatcctggctcaggacgaacgctggcggcgtgcctaacacatgcaagtcgaacggacgaggggagcttgctccccgagttagtggcgaacgggtgagtaacgcgtgagtaacctgccttggagagggggacaacagccggaaacggctgctaataccgcataacgtcgttgggaggcatcttccgacgaccaaagatttatcgctctgagatggactcgcgtccgattagatagttggcggggcaacggcccaccaagtcgacgatcggtagccggactgagaggttgaacggccacattgggactgagatacggcccagactcctacgggaggcagcagtgaggaatattgggcaatgggcgaaagcctgacccagcaacgccgcgtgaaggaagaaggttttcggattgtaaacttcttttcttcgggacgaaaactgacggtaccgaaggaataagccacggctaactacgtgccagcag

SEQ ID NO: 4567 - DNA, 487 bp, Unknown
  Ascusbbf_477840, encodes 16S rRNA
agagtttgatcatggctcaggacgaacgctggcggcgtgcctaacacatgcaagtcaagggactcttcggagtcactggcgaacgggtgagtaacgcgtggataatctgcccttatctccggaataacatcaagaaattggtgctaaaaacggatgaggcacattgtgtcaaaggaaacggataaggatgagtccgcgtctgattagcttgttggtgaggtaaaggctcaccaaggctgcgatcagtagctggtctgagaggacgatcagccacactggaactgagacacggtccagactcctacgggaggcagcagtgaggaattttgcacaatggaggaaactctgatgcagcgacgccgcgtgcgggatgaaagggctttgccttgtaaaccgctgtcggatgggaaaaaaagttccctcgggggactgggattgtaccatcaaaggaaggaccggctaactacgtgccagcagccgcggtaat

SEQ ID NO: 4568 - DNA, 468 bp, Unknown
  Ascusbbf_914679, encodes 16S rRNA
agagtttgatcatggctcagaacgaacgctggcggcaggcttaacacatgcaagtcgaacgcatcgcaagatgagtggcagacgggtgagtaacgcgtgggaatctacccttttctacggaacaactgagggaaacttcagctaataccgtatacggcctttgggcgaaagatttatcggagaaggatgagcccgcgttggattagctagttggtggggtaaaggcctaccaaggcgacgatacatagctggtctgagaggatgatcagccacactgggactgagacacggcccagactcctacgggaggcagcagtggggaatattggacaatgggcgcaagcctgatccagccatgccgcgtgtgtgatgaaggtcttaggattgtaaagcactttcaccggagaagataatgacggtatccggagaagaagccccggctaacttcgtgccagcagccgcggtaat

SEQ ID NO: 4569 - DNA, 490 bp, Unknown
  Ascusbbf_720583, encodes 16S rRNA
agagtttgatcatggctcaggacgaacgctggcggcgtgcctaacacatgcaagtcgagcggagcttaagaagtcagaagttttcggacggaagacattttaagcttagcggcggacgggtgagtaacgcgtgggcaatctgcccttcacagggggataacacagggaaacttgtgctaataccgcataagatcgtataacggcatcgttaagcgaccaaaggagcgatccggtgaaggaggagcccgcgtctgattagatagttggtgaggtaacggcccaccaagtcgacgatcagtagccgaactgagaggttgatcggccacattgggactgagacacggcccagactcctacgggaggcagcagtggggaatattgcacaatggaggaaactctgatgcagcaacgccgcgtgaaggaagaaggtcttcggattgtaaacttctttgatcggggacgaagaatgacggtacccgaaaaacaagcc

SEQ ID NO: 4570 - DNA, 490 bp, Unknown
  Ascusbbf_320556, encodes 16S rRNA
agagtttgatcatggctcaggacaaacgctggcggcgtgcctaatacatgcaagtcgaacgagaatctgaagcttgcttcagaggaaagtggcggacgggtgagtaatatgtaggaaatctgcccttacgtgggggacaacagttggaaacgactgctaataccccataggagattagttgaaatactaatttttaaagatttatcgcgtaaggatgagcctgcatctgattagcttgttggtggtgtaatggactaccaaggcgacgatcagtagctggtttgagaggatgatcagccacaatgggactgagacacggcccatactcctacgggaggcagcagtagggaattttgcgcaatgggcgaaagcctgacgcagcaacgccgcgtgagtgatgaagcccctcggggtgtaaaactctgtcagtagggacaaattttgatggtacctacagaggaagcatcggctaactacgtgccagcagccg

SEQ ID NO: 4571 - DNA, 170 bp, Unknown
  Ascusbbf_174837, encodes 16S rRNA
agagtttgatcctggctcagtaagaattgactagcccaagtgatcggacaactaagaatgtaggaatcatcccgccgctaaacaacattgagaatacaaccataaaattgacgaatcctctaccaaataaatatcttcttgataaaccataagccagcagccgcggtaat

SEQ ID NO: 4572 - DNA, 253 bp, Unknown
  Ascusbbf_481933, encodes 16S rRNA
agagtttgatcctggctcagattgaacgctggcggcgtgcttaacacatgcaagtcgaacgaagaaggttagaatgagagcttcggcaggatttttatctatcttagtggcggacgggtgagtaacgtgtgggcaacctgccctgtactggggaataatcattggaaacgatgactaataccgcatgtggtcctcgggaggcatcttcttatgaataaggatcggctaactccgtgccagcagccgcggtaat

SEQ ID NO: 4573 - DNA, 490 bp, Unknown
  Ascusbbf_699778, encodes 16S rRNA
agagtttgatcatggctcagattgaacgctggcggcaggcttaacacatgcaagtcgagcggtaacaggggagcttgctcctgctgacgagcggcgaacgggtgagtaacgcgtaggaatctacctggtagtgggggataacccggggaaactcgggctaataccgcatacgctccacggaggaaagcgggggatcttcggacctcgcgctatcagatgagcctgcgtaggattagctagttggtggggtaaaggctcaccaaggcgacgatccttagctggtctgagaggatggccagtcacaccggaactgagacacggtccggactcctacgggaggcagcagtggggaatcttggacaatgggggcaaccctgatccagccatgccgcgtgggtgaagaaggccttcgggttgtaaagcccttttgttggggaggaaaggttgccggcgaatacctggtgactgtgacgttacccaaagaataagc

SEQ ID NO: 4574 - DNA, 490 bp, Unknown
  Ascusbbf_997610, encodes 16S rRNA
agagtttgatcatggctcaggatgaacgctggcggcgtgcttaacacatgcaagtcgaacggacgccgtctggaagcggagtgagcttgctcatgaaacggaaggatgatgttagtggcggacgggtgagtaacgcgtgggtaacctgcctcacattgggggataccagtcggaaacgactgctaaaaccgcataagaccacgaaaccgcatggtatcgcggccaaaactccggtgatgtgagatggacccgcgtctgattagccagttggcggggtaacggcccaccaaagcgacgatcagtagccgacctgagagggtgatcggccacattgggactgagacacggcccaaactcctacgggaggcagcagtggggaatattgcacaatgggggaaaccctgatgcagcgacgccgcgtgagtgatgaagtatttcggtacgtaaagctctatcagcaggaacgataatgacggtacctgactaagaa

SEQ ID NO: 4575 - DNA, 490 bp, Unknown
  Ascusbbf_1735951, encodes 16S rRNA
agagtttgatcatggctcaggatgaacgctggcggcgtgcctaatacatgcaagtcgaacgaggccctctgtacttgtatagaggtgtcctagtggcgaacgggtgagtaacgcgttggtgacctgccccgaagtgggggataacagttcgaaaggactgctaataccccatgtgactgtgagagttagaggtctcactatcaaaggagtaatccgcttcgggaggggcctgcgtcccatcagctagttggtaaggtaatggcttaccaaggcttagacgggtaggggacctgagagggtgaccccccacactggaactgaaacacggtccagacacctacgggtggcagcagtagggaatattgcacaatgggcgaaagcctgatgcagcaacgccgcgtgcacgatgaaggccttcgggttgcaaagtgcttttatgagggaagggaaaggactgtacctcatgaataaggatcggctaactacgtgc

SEQ ID NO: 4576 - DNA, 490 bp, Unknown
  Ascusbbf_1858718, encodes 16S rRNA
agagtttgatcatggctcagaacgaacgctggcggcaggcttaacacatgcaagtcgagcgccccgcaaggggagcggcagacgggtgagtaacgcgtgggaatctacccatctctacggaataactcagggaaacttgtgctaataccgtatacgcccttcgggggaaagatttatcggagatggatgagcccgcgttggattagctagttggtgaggtaaaggctcaccaaggcgacgatccatagctggtctgagaggatgatcagccacactgggactgagacacggcccagactcctacgggaggcagcagtggggaatattggacaatggggggaaccctgatccagccatgccgcgtgtgtgaagaaggccttatggttgtaaagcactttaagcgaggaggaggctactttagttaatacctagggatagtggacgttactcgcagaataagcaccggctaactctgtgccagcagccgcgg

SEQ ID NO: 4577 - DNA, 490 bp, Unknown
  Ascusbbf_787897, encodes 16S rRNA
agagtttgatcatggctcagattgaacgctggcggcaggcctaatacatgcaagtcgaacggtaacataagaaaagcttgcttttcttgatgacgagtggcggacgggtgagtaacatttgggaaactacctgatagagggggacaacagttggaaacgactgctaataccgcatacagcctaagggtgaaagaagcaattcgctatcagatgtgcccaaacgggattagctagttggtgaggtaacggcccaccaaggcgatgatacatagccggtctgagaggatgaacggccacattgggactgagacacggcccagactcctacgggaggcagcagtaaggaattttcggcaatggacgaaagtctgaccgagcaacgccgcgtgagtgatgaaggcctttgggttgtaaagctctgtggtagaggaagaacaccatggataggaaatgctccatggctgacggtactcttctagaaagtcacggc

SEQ ID NO: 4578 - DNA, 490 bp, Unknown
  Ascusbbf_1610597, encodes 16S rRNA
agagtttgatcctggctcaggatgaacgctggcggcgtgcctaatacatgcaagtcgaacggaagcacttcggtgctttagtggcgaacgggtgagtaacacgtaggtaacctgcccataagacgcggataacagttggaaacgactgctaatacacgataggtaacttgagcgcatgtttaagttattaaaggtccgaatggactacttatggaggggcctgcggcgcattagttagttggtggggtaagagcttaccaagacgatgatgcgtagccggactgagaggttgaacggccacattgggactgagacacggcccaaactcctacgggaggcagcagtagggaattttcggcaatggggggaaccctgaccgagcaacgccgcgtgaatgacgaagcacttcggtgcgtaaaattcttttattagggaagaatgacagatggaggaaatgccatgtgtgtgacggtacctaatgaataagccc

SEQ ID NO: 4579 - DNA, 490 bp, Unknown
  Ascusbbf_1817560, encodes 16S rRNA
agagtttgatcatggctcaggatgaacgctagcggcaggcttaacacatgcaagtcgaggggtataagtagcttgctacttagagaccggcaaacgggtgcggaacacgtacgcaatctgcccttatctcagggatagcccagagaaatttggattaatacctgatagtattattggaaggcatcttttagtaattaaagatttattggataaggatgagcgtgcgtaagattagatagttggtagggtaacggcctaccaagtctacgatctttagctgatgtgagagcatgatcagccacacgggcactgagacacgggcccgactcctacgggaggcagcagtgaggaatattggtcaatggacggaagtctgaaccagccatgccgcgtgaaggatgaaggcgttctgcgttgtagacttcttttatgtaggaagaaaccactcttatctaagagtgttgacggtactatatgaataagcaccggc

SEQ ID NO: 4580 - DNA, 490 bp, Unknown
  Ascusbbf_1293027, encodes 16S rRNA
agagtttgatcctggctcagattgaacgctggcggcaggcctaacacatgcaagtcgaacggtaacaggaagcagcttgctgtttcgctgacgagtggcggacgggtgagtaatgtctgggaaactgcctgatggagggggataactactggaaacggtagctaataccgcataagcgcacagcttcgcatgaagcggtgtgaaaaactccggtggtatgggatggacccgcgtctgattaggtagttggtggggtaacggcctaccaagccaacgatcagtagccggcctgagagggtggacggccacattgggactgagacacggcccaaactcctacgggaggcagcagtggggaatattgcacaatgggggaaaccctgatgcagcgacgccgcgtgaaggaagaagtatttcggtatgtaaacttctatcagcagggaagaaaatgacggtacctgactaagaagccccggctaactacgtgcca

SEQ ID NO: 4581 - DNA, 490 bp, Unknown
  Ascusbbf_1540703, encodes 16S rRNA
agagtttgatcatggctcaggatgaacgctggcggcgtgcctaatacatgcaagtcgaacgaagcacttcggtgcttagtggcgaacgggtgagtaacacgtaggtaacctgtccttaagctgaggataacgtttggaaacgaacgctaatactcaataggtaatagagaggcatctctctattattaaagatcctttaggggattacttaaggaggggcctgcgtcgcattagttagttggtggggtgatggcctaccaagacgatgatgcgtagccggactgagaggttgaacggccacactgggactgagacacggcccagactcctacgggaggcagcagtagggaattttcggcaatggggggaaccctgaccgagcaacgccgcgtgaatgaagaagctcctcggagcgtaaaattcttttattaaggaagaatactattaataggaaatgattagtaaatgacggtacttaatgaataaggcc

SEQ ID NO: 4582 - DNA, 467 bp, Unknown
  Ascusbbf_1687288, encodes 16S rRNA
agagtttgatcatggctcagaacgaacgttggcggcgtggattaggcatgcaagtcgagtgggtttaggcccacggcgaaagggacagtaacacgtggatacttgccttggggttcgggataaccgcgggaaactgcggataataccgaataatgtctccggaccaaagatttatcaccccaagagaggtccgcgtcctattagctagttggcggggtaacggcccaccaaggcaacgatgggtagcgggtgtgagagcacgacccgcgtcactgggactgagatactgcccagacacctacgggtggctgcagtcgagaatcttcggcaatgggcgaaagcctgaccgagcgacgccgcgtgcgggatgaaggccctcgggttgtaaaccgctgtggagaaggagtaaacactgaacgatttctctagaaagcacaggctaagttcgtgccagcagccgcggtaat

SEQ ID NO: 4583 - DNA, 469 bp, Unknown
  Ascusbbf_1150905, encodes 16S rRNA
agagtttgatcctggctcagaacgaacgctggcggtaggcctaacacatgcaagtcgagcgaagtcttcggacttagcggcggacgggtgagtaacgcgtgggaacatgcccagaggtacggaacaacagttggaaacggctgctaataccgtatacgccctacgggggaaagaatttcgcctttggattggcccgcgttggattagatagttggtggggtaacggcctaccaagtctacgatccatagctggtttgagaggatgatcagccacactgggactgagacacggcccagactcctacgggaggcagcagtggggaatcttagacaatgggcgaaagcctgatctagccataccgcgtgagcgatgaaggccttagggttgtaaagctctttcgccagggatgataatgacagtacctggtaaagaagtcccggctaactccgtgccagcagccgcggtaat

SEQ ID NO: 4584 - DNA, 490 bp, Unknown
  Ascusbbf_1196906, encodes 16S rRNA
agagtttgatcctggctcaggacgaacgctggcggcgtgcttaacacatgcaagtcgaacggagtattagaaatgaagttttcggatggatttttagtacttagtggcggacgggtgagtaacgcgtgggtaacctgcctcacacagggggataacagttggaaacgactgttaataccgcataagaccacagtaccgcatggtacaggggtaaaaactccggtggtgtgagatggacccgcgtctgattagttagttggcggggtaacggcccaccaagacgacgatcagtagccgatctgagaggatgaccggccacattggtactgagacacggaccaaactcctacgggaggcagcagtgaggaatattggtcaatgggcgagagcctgaaccagccaagtagcgtgcaggacgactgccctatgggttgtaaactgcttttatcagggaataaagtgcggcacgtgtgccgttttgtatgtacct

SEQ ID NO: 4585 - DNA, 470 bp, Unknown
  Ascusbbf_582570, encodes 16S rRNA
agagttgtcatggctcagaacgaacgctggcggcatgcctaacacatgcaagtcgaacgagatcttcggatctagtggcggacgggtgagtaacgcgtgggtatctgccctggagcgtggaataaccgctggaaacggcggctaataccgcatacgccctgagggggaaaggcttcggccactctgggaggaacccgcgtccgattagctagttggaggggtaacggcccaccaaggcgacgatcggtagctggtctgagaggatgatcagccacactgggactgagacacggcccagactcctacgggaggcagcagtggggaatattggacaatgggggaaaccctgatccagcaatgccgcgtgcgtgaagaaggccttagggttgtaaagcgctttcgcccgcgaagatgatgacggtagcgggagaagaagccccggctaactccgtgccagcagccgcggtaat

SEQ ID NO: 4586 - DNA, 467 bp, Unknown
  Ascusbbf_1604304, encodes 16S rRNA
agagtttgatcatggctcagaacgaacgctggcggcaggcttaacacatgcaagtcgagcgcgtagcaatacgagcggcagacgggtgagtaacgcgggggatgtgcctggtgatacggaacaactcagggaaacttgagctaataccgtataagcccttcgggggaaagatttatcgccaccagatcaacccgcgttggattagctagttggtgaggtaacggctcaccaaggcgacgatccatagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagctctttcactggggaagataatgacggtacccagagaagaagccccggctaacttcgtgccagcagccgcggtaat

SEQ ID NO: 4587 - DNA, 490 bp, Unknown
  Ascusbbf_1170186, encodes 16S rRNA
agagtttgatcctggctcaggacgaacgctggcggcgtgcctaacacatgcaagtcgaacggagatatggggcttgctccatatcttagtggcggacgggtgagtaacgcgtgagtaacctgcctttcagagggggatagccattggaaacgatggataataccgcataacgtatcattgtcgcatggcagagataccaaaggagcaatccgctgaaagatggactcgcgtccgattagatagttggtgaggtaacggcccaccaagtcgacgatcggtagccggactgagaggttgaacggccacattgggactgagacacggcccagactcctacgggaggcagcaatgagggatattgcacaatgggcgaaagcctgatgcagcaacgccgcgtgagggatgacggttttcggattgtaaacctctgtcttcggtgaagataatgacattagccgaggaggaagccacggctaactacgtgccagca

SEQ ID NO: 4588 - DNA, 490 bp, Unknown
  Ascusbbf_1787936, encodes 16S rRNA
agagtttgatcatggctcagaatgaacgttggcggcgtggattaggcatgcaagtcgaacggtaaggtcacttagcttgctttgtgaccctagagtggcgaaagggatagtatcatgtagatcatatacccgagggtaggggatagcgtctggaaacgggcggtaataccctataatatctccggatgaaaggtgagattccgccttcggattagtttacacactattagctagttggtgaggtaaaggcccaccaaggcgacgatggttaccgggcgtgagagcgtgacccggatcactgggactgagacactgcccagacacctacgggtggctgcagtcgagaatcttcggcaatggacgaaagtctgaccgagcgacgccgcgtgtatgatgaaggtcttcggattgtaaagtactgtcgattaggcggaaatatataggggcactcccttatatttgacctatcattggaggaaggacgggctaa

SEQ ID NO: 4589 - DNA, 490 bp, Unknown
  Ascusbbf_912241, encodes 16S rRNA
agagtttgatcatggctcagagcgaacgctggcggcatgcttaacacatgcgagtcgcacgaaggtttcggccttagtggcggacgggtgagtaacgcgtaggtatctatccatgggtgggggataacactgggaaactggtgctaataccgcatgacacctgagggtcaaaggcgcaagtcgcctgtggaggagcctgcgtttgattagctagttggtggggtaaaggcctaccaaggcgatgatcaatagctggtttgagaggatgatcagccacactgggactgagacacggcccagactcctacgggaggcagcagtagggaatcttccgcaatggacgaaagtctgacggagcaacgccgcgtgagtgatgaaggttttcggatcgtaaagctctgttgccagggaagaacgtccgttagagtaactgctaacggagtgacggtacctgagaagaaagccccggctaactacgtgccagcagccg

SEQ ID NO: 4590 - DNA, 490 bp, Unknown
  Ascusbbf_1014459, encodes 16S rRNA
agagtttgatcatggctcaggacgaacgctggcggcgtgcctaacacatgcaagtcgaacggacatactagcaatagtatgttagtggcggacgggtgagtaatacatgagtaacctgccttatacagggggataacacttagaaataggtgctaataccgcatgataacccttggtggcatcactaggggaggaaaggagaaatccagtaaaagatgggctcatgttcgattagctagttggtgaggtaatggctcaccaaggccacgatcgatagccgaactgagaggttgaacggccacattggaactgagagacggtccagactcctacgggaggcagcagtgggggatattgcgcaatgggggaaaccctgacgcagcaacgccgtgtgaaggaagaaggctttagggttgtaaacttctttgattagggacgaataaatgactgtacctaaggaacaagccacggctaactacgtgccagcagc

SEQ ID NO: 4591 - DNA, 490 bp, Unknown
  Ascusbbf_1504879, encodes 16S rRNA
agagtttgatcatggctcagaatgaacgttggcggcgtggattaggcatgcaagtcgagcggcaaggttccttcgggagccctagagcggcggaagggataggaacatatagataacatgcctcctaggtcgggatagcgtcgggaaactggcgataataccggatgtggtcttcggactaaaggtgcgattcccttaggagattggtctatatcctattagctagttgggggggtaatggcccaccaaggcaatgatgggtacgtggcgtgagagcgcgaccacgatcactgggactgagacactgcccagacgcctacgggcggctgcagtcgagaatcttcggcaatggacgaaagtctgaccgagcgacgccgcgtgtatgaagaaggtcttcggattgtaaaatactgtcgatagggcggaaatttaggagcgcaatcgttcctatttgacctatcttttgaggaaggacgggctaagttcgtgc

SEQ ID NO: 4592 - DNA, 362 bp, Unknown
  Ascusbbf_1092654, encodes 16S rRNA
agagtttgatcctggctcaggatgaacgctggcggcgcgtcttaagcatgcaagtcgagcggtaagatatagcttgctatatcctagagcggcggactggtgagtaacacgtgggtgacataccctccggaccgggatagctcctagaaataggagataatacctgatacgatttctgttgtcagaggacaggaaggaaaggtgcttcggcaccgccggaggagtggcccgcggcccattagctagttggtgaggtaacggcccaccaaggcgacgatgggtatccggcctaagagggtggacggacacattgggactgagatacggcccagactcctacgggagccagcagccgcggtaat

SEQ ID NO: 4593 - DNA, 490 bp, Unknown
  Ascusbbf_597729, encodes 16S rRNA
agagtttgatcatggctcaggacgaacgctggcggcgtgcttaacacatgcaagtcgagcgaggcgcctcttacgagaggcagccgagcggcgaacggctgagtaacacgtgagcaactcaccctcggctccgggataacctcgggaaactgaggctaataccggatacgaccatgcacggcatcgtgcgtggtggaaaggtggccgcccgcgagggcggtctccggccgaggacaggctcgcggcctatcagctagtcggtgggataacggctcaccgaggcattgacgggtagccgacctgagagggtgaccggccagactgggactgagacacggcccagactcctacgggaggctgcagtggggaatcttgcgcaatgggcgaaagcctgacgcagcaacgccgcgtgggggacgacagccttcgggtcgtaaacctcttttcctgccaacgaaggttccaggtattcttgggattgactgtacgc

SEQ ID NO: 4594 - DNA, 490 bp, Unknown
  Ascusbbf_1278879, encodes 16S rRNA
agagtttgatcctggctcagattgaacgctggcggcaggcttaacacctgcaagtcgaacggtaacggggagaaagcttgctttctttgccgacgagtggcggacgggtgagtaatgcttgggaatctggcttatggagggggataactacgggaaactgtagctaataccgcgtaatgtctatggactaaagggtgggactttcgggccacctgccataagatgagcccaagtgggattaggtagttggtggggtaaaggcctaccaagcctgcgatctctagctggtctgagaggatggccagccacactggaactgagacacggtccagactcctacgggaggcagcagtggggaatattgcacaatggggggaaccctgatgcagccatgccgcgtgaatgaagaaggccttagggttgtaaagttctttcggtgatgaggaaggagcataatttaatagattatgctattgacgttaatcacaga

SEQ ID NO: 4595 - DNA, 490 bp, Unknown
  Ascusbbf_1621183, encodes 16S rRNA
agagtttgatcatggctcaggatgaacgctggcggcgtgcttaacacatgcaagtcgaacggagttataaagacgaagccctcgggcctaggctttgtaacttagtggcgaacgggtgagtaacacgtgagtaacctgcctatttccgggggataacaacgggaaaccgttgctaataccgcataaactgtcgaggtggcatcactttgacaggaaagatttatcgggaatagaggggctcgcgtccgattagttagttggtggggtaatggcctaccaagaccgcgatcggtagccggactgagaggttgatcggccacattgggactgagacacggcccagactcctacgggaggcagcagtggcgaatattgggcaatgggcgcaagcctgacccagcaacgccgcgtgaaggaagaaggctttcgggttgtaaacttctttggccagggacgataatgacggtacctggagaacaagccacggcta

SEQ ID NO: 4596 - DNA, 490 bp, Unknown
  Ascusbbf_502970, encodes 16S rRNA
agagtttgatcatggctcaggatgaacgctggcggcgtgcctaacacattcaagtcgaacgggacttatttggtagcaataccggataagtttagtggcggacgggtgagtaacgcgtgagcaatctgcctccggttgcgggacaacacagggaaacttgtgctaataccgcataaaccggcagcaccgcatggtgcaaccggcaaagaatttcgaccggagatgagctcgcgtccgattagatagttggcggggcaacggcccaccaagtctgcgatcggtagccggactgagaggttgaacggccacattggaactgagatacggtccagactcctacgggaggcagcagtggggaatattgggcaatgggcgaaagcctgacccagcgacgccgcgtgaaggaagaaggtcttcggattgtaaacttcagtcaacagggaagatcatgacggtacctgtggaggaagccacggctaactacgtgcca

SEQ ID NO: 4597 - DNA, 490 bp, Unknown
  Ascusbbf_852646, encodes 16S rRNA
agagtttgatcatggctcaggacgaacgctggcggcgtgcttaacacatgcaagtcgaacgatgaaccggcttcggctggggattagtggcgaacgggtgagtaacacgtgggtaacctgccctcagcttggggataagcctgggaaactgggtctaatacccgatatgaccatctcgcgcatgtggggtggtggaaagtttttcggctggggatgggcccgcggcctatcagcttgttggtggggtgatggcctaccaaggcgacgacgggtagccggcctgagagggtgttcggtcacactgggactgagacacggcccagactcctacgggaggcagcagtggggaatattgcgcaatgggcgaaagcctgacgcagcgacgccgcgtgggggatgacggccttcgggttgtaaacctctgttgcccgcgacgaagcccttcggggtgacggtagtgggtgaggaagcaccggctgactacgtgcca

SEQ ID NO: 4598 - DNA, 490 bp, Unknown
  Ascusbbf_529676, encodes 16S rRNA
agagtttgatcctggctcaggatgaacgctagcggcaggcctaacacatgcaagtcgaggggtagagcacttcggtgcttgagaccggcgcacgggtgcgtaacgcgtatgcaatctaccttatactaagggatagcccagagaaatttggattaataccttatagttaatagaattggcatcgattttattataaagatttattggtataagatgagcatgcgtcccattagttagttggtaaggtaacggcttaccaagacgatgatgggtaggggtcctgagagggagatcccccacactggtactgagacacggaccagactcctacgggaggcagcagtgaggaatattggtcaatggacggaagtctgaaccagccatgccgcgtgcaggatgaagcatctatggtgtgtaaactgcttttgtacgggaagaaaaaacattacgtgtaatgtactgacggtaccgtaagaataaggatcggcta

SEQ ID NO: 4599 - DNA, 490 bp, Unknown
  Ascusbbf_639474, encodes 16S rRNA
agagtttgatcctggctcaggacgaacgctggcggcacgcttaacacatgcaagtcgaacggagctaaggagttcgctctttagcttagtggcggacgggtgagtaacacgtgagcaacctgcctttcagtgcggaatagcttctggaaacggatggtaataccgcataacgttacgggaccgcatgatcctgtaaccaaagaatttcgctgaaagatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggcgcaagcctgatgcagcgatgccgcgtggaggaagaaggttttcggattgtaaactcctgatctgagggacgataatgacggtacctcaggagaaagctccggctaactacgtgccagcagcc

SEQ ID NO: 4600 - DNA, 490 bp, Unknown
  Ascusbbf_588729, encodes 16S rRNA
agagtttgatcatggctcagattgaacgctggcggcatgcctaacacatgcaagtcgcgcggacggtagcaataccgttagcggcggacgggtgaggaacacataggaatttgcctcagagcgggggatagcccagggaaacttggagtaataccgcatgatgtcgcaagaccaaagctggggaccgcaaggcctagcactctgagagaagcctatgtctgattagctagttggtagggtaatggcctaccaaggcgacgatcagtaactggtctgagaggacgatcagtcacaccggaactgagacacggtccggactcctacgggaggcagcagtggggaatattggacaatgggcgcaagcctgatccagcaatgccgcgtgtgtgaagaaggccttcgggttgtaaagcactttaagcagggaagaaaaaacgcgctctaacatagtgcgtcttgacggtacctgaagaataagcaccggctaact

SEQ ID NO: 4601 - DNA, 490 bp, Unknown
  Ascusbbf_1839215, encodes 16S rRNA
agagtttgatcatggctcaggacgaacgctggcggcgtgcttaacacatgcaagtcgagcggaaaggccccttcgggggtactcgagcggcgaacgggtgagtaacacgtgagtaacctgcccttggcttcgggataagcccgggaaactgggtctaataccggataggacacatggctgcatggtctgtgtgtggaaagatttatcggctgaggatggactcgcggcctatcagtttgttggtggggtaatggcctatcaaggcgaagacgggtagccggcctgagagggcgaccggccacactgggactgagacacggcccagactcctacgggaggcagcagtggggaatcttgcgcaatgggcgaaagcctgacgcagcaacgccgcgtgagggatgacggccttcgggttgtaaacctctttcagcgctgacgaagcctttcggggtgacggtaggcgcagaagaagcaccggctaactacgtgc

SEQ ID NO: 4602 - DNA, 469 bp, Unknown
  Ascusbbf_1501917, encodes 16S rRNA
agagtttgatcctggctcagaacgaacgctggcggcaggcttaacacatgcaagtcgaacgggcccttcggggtcagtggcagacgggtgagtaacgcgtgggaacgtgcccttcagtttggaataacccagggaaacttgggctaataccggatacgcccgcaaggggaaagatttatcgctgaaggatcggcccgcgtctgattagctagttggtgaggtaatggctcaccaaggcgacgatcaatagctggtctgagaggatgatcagccacattgggactgagacacggcccaaactcctacgggaggcagcagtggggaatattggacaatgggcgcaagcctgatccagccatgccgcgtgagtgatgacggccttagggttgtaaagctctttcagtggggacgataatgacggtacccgcagaagaagccccggctaacttcgtgccagcagccgcgtaat

SEQ ID NO: 4603 - DNA, 490 bp, Unknown
  Ascusbbf_1033709, encodes 16S rRNA
agagtttgatcatggctcaggacgaacgctggcggcgtgcctaacacatgcaagtcgagcgggaaacttgaagcggagacttcggttgaagctttaagcggagagcggcggacgggtgagtaacgcgtgagtaacctgccctacagagggggataacacagtgaaaactgtgctaatacgccataacatataatattcgcatggataatatatcaaagatttatcgctgtaggatggactcgcgtctgattagcttgttggtagggtaacggcctaccaaggcgacgatcagtagccgaactgagaggttgatcggccacattgggactgagacacggcccagactcctacgggaggcagcagtggggaatattgcgcaatggggggaaccctgacgcagcaacgccgcgtgaaggaagaaggctttcgggtcgtaaacttttgtcttaggggacaaataatgacggtaccttaggaggaagccacggct

SEQ ID NO: 4604 - DNA, 490 bp, Unknown
  Ascusbbf_1900711, encodes 16S rRNA
agagtttgatcatggctcaggatgaacgctagcggcaggcctaatacatgcaagtcgaacggtatcccgccttcgggtgggagagagtggcgcacgggtgcgtaacgcgtatgcaacctgccctttacagggggatagcccggggaaacccggattaataccccatgtttcctaatcccggcatcggggatagggcaaagcctttgggcggtatgggatgggcatgcgtaggattagctagttggcggtgtaacggaccaccaaggctgcgatccttaggggttctgagaggaaggtcccccacactggcactgagatacgggccagactcctacgggaggcagcagtagggaatattgggcaatgggcggaggcctgacccagccatgccgcgtgcaggaagacggcgttctgcgttgtaaactgcttttatacgggaagaaaaggcccatgcgtgggacattgccggtaccgtatgaataagcaccgg

SEQ ID NO: 4605 - DNA, 490 bp, Unknown
  Ascusbbf_1681202, encodes 16S rRNA
agagtttgatcctggctcagattgaacgctggcggcaggcttaacacatgcaagtcgagcggtaacaggggtgcttgcacccgctgacaagcggcgaacgggtgagtaatgcataggaatctacctagtagagggggatagcccggggaaactcggattaataccgcatacgtcctacgggagaaagcaggggatcttcggaccttgcgctattagatgagcctatgtcggattagctagttggtggggtaaaggcctaccaaggcgacgatccgtagctggtctgagaggatgatcagccacactggaactgagacacggtccagactcctacgggaggcagcagtggggaatattggacaatgggggaaaccctgatccagccatgccgcgtgtgtgaagaaggccttcgggttgtaaagcactttaagcagggaggaaagggtgatggctaatatccattatcattgacgttacctgcagaataagc

SEQ ID NO: 4606 - DNA, 490 bp, Unknown
  Ascusbbf_813022, encodes 16S rRNA
agagtttgatcatggctcaggacgaacgctggcggcgtgcataacacatgcaagtcacgggggcctttcggggcaaccggcgaacgggtgcgtaacacgtgagcaacctgccctggtgtggggcatagccggcctaacggccgggtaattccgcatacgatccttggggtgcatttctcgaggatgaaaccagtaatgggcactaggaggggctcgcggcctatcagcttgttggcgaggtaacggctcaccaaggcgacgacgggtagctggtctgagaggatgaccagccacattgggactgagatacggcccagactcctacgggaggcagcagtggggaatattgcgcaatggcctaacggctgacgcagcgacgccgcgtgagggatgaagcttttcggagtgtaaacctctgttgctcgggacgaattgccagatttctctggtttgacggtaccgagtgaggaagcaccggctaactccgtgc

SEQ ID NO: 4607 - DNA, 175 bp, Unknown
  Ascusbbf_313613, encodes 16S rRNA
agagtttgatcctggctcagccactatgctgtaatccgtattccaactcacgctgtcctgcgtgagccctgcctctttgacctgcatggtgtagtcaccgatgtttgctttctcatcagccgccgagataatcgaaaagtccgcgaaggaatcgcctgccagcagccgcggtaat

SEQ ID NO: 4608 - DNA, 490 bp, Unknown
  Ascusbbf_515121, encodes 16S rRNA
agagtttgatcatggctcaggacgaacgctggcggcgtgcttaacacatgcaagtcgagggcactccttcgggggtgaccggcgaacgggtgcgtaacacgtgagcaacctgcccgcttgtggggaatagccggcccaacggccgggtaataccgcatacgttccacggttcacctggactgtggaggaaagctttatgcgcaggcggaggggctcgcggcctatcagctagttggtgcggtaacggcgcaccaaggcattgacgggtagctggtctgagaggatggccagccacattgggactgcgacacggcccagactcctacgggaggcagcagtggggaatattgcgcaatggccgcaaggctgacgcagcgacgccgcgtgggggaggaaggttttcggatcgtaaacccctgttgcccgggacgaaccgctggtttagaccagcctgacggtaccgggtgaggaagcaccggctaactccgtg

SEQ ID NO: 4609 - DNA, 468 bp, Unknown
  Ascusbbf_711546, encodes 16S rRNA
agagtttgatcatggctcagaacgaacgctggcggcaggcttaacacatgcaagtcgaacgccccgcaaggggagtggcagacgggtgagtaacgcgtgggaacctaccccttggtacgggatagctccgggaaactggagataataccgtatgtgtcctgagggacaaagattcatcgccaagggatgggcccgcgtcggattagctagttggtggggtaatggcctaccaaggcgacgatccgtagctggtctaagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaccggtgacgataatgacggtagccggagaagaagccccggctaacttcgtgccagcagccgcggtaat

SEQ ID NO: 4610 - DNA, 470 bp, Unknown
  Ascusbbf_574582, encodes 16S rRNA
agagtttgatcctggctcagaacgaacgctggcggcaggcttaacacatgcaagtcgaacgcacccttcggggtgagtggcagacgggtgagtaacgcgtgggaacctacctatcggttcggaataacttcgggaaaccgaaactaataccggatacgccccaagggggaaagatttatcgccgattgatgggcccgcgttggattagcttgttggtgaggtaacggctcaccaaggctgcgatccatagctggtctaagaggatgatcagccacactgggactgagacacggcccagactcctacgggaggcagcagtggggaatattggacaatgggcgaaagcctgatccagccatgccgcgtgagtgatgagggccttagggttgtaaagctctttcgctagggaagataatgacggtacctagtaaagaagccccggctaacttcgtgccagcagccgcggtaat

SEQ ID NO: 4611 - DNA, 245 bp, Unknown
  Ascusbbf_682189, encodes 16S rRNA
agagtttgatcctggctcaggacgaacgctggcggcgtgcttaacacatgcaagtcgaacgagaattcgtggatagaggtttcggccaattgaagcggagaaaagtggcggacgggtgagtaacgcgtgaggaacctgcctttcagagggggacaacagttggaaacgactgctattggggacgagtagaagacggtacctgacgaataagccacggctaactacgtgccagcagccgcggtaat

SEQ ID NO: 4612 - DNA, 490 bp, Unknown
  Ascusbbf_751242, encodes 16S rRNA
agagtttgatcctggctcaggatgaacgctagcggcaggcttaacacatgcaagtcgaggggcagcgcgaggtagcaatactttggcggcgaccggcgcaagggtgcgtaacgcgtgagcaacttgcccgcaacaggaggataaccggaggaaactccgactaatactgcgtagcaacggattgtggcatcacagaccgtttaaaggcgaaagctggttgcggataggctcgcgtgacattagctagatggcggggtaacggcccaccatggcgacgatgtctaggggttctgagaggaaggtcccccacactggtactgagacacggaccagactcctacgggaggcagcagtgaggaatattggacaatggtcggaagactgatccagccatgccgcgtgaaggctaaggtcctatggattgtaaacttcttttgtacgagaggaataaggtggacgtgtccaccgaggacagtatcgtacgaataag

SEQ ID NO: 4613 - DNA, 490 bp, Unknown
  Ascusbbf_1770991, encodes 16S rRNA
agagtttgatcatggctcaggatgaacgctagcgacaggcctaacacatgcaagtcgaggggcagcacgtcttcggatggtggcgaccggcgcacgggtgagtaacgcgtatgcaacctacctgtaactgggggatagctccctgaaaggggaattaacaccgcataagaccacgctttcgcatggaagagtggtaaaatatttataggttacagatgggcatgcgtgacattagtttgttggtgaggtaacggctcaccaagactacgatgtctaggggttctgagaggaaggtcccccacactggtactgagacacggaccagactcctacgggaggcagcagtgaggaatattggtcaatgggcgcaagcctgaaccagccatgtcgcgtgcaggaagacggccctatgggttgtaaactgcttttgtatgggaagaaattgctcgacgtgtcgggcattgccggtaccatacgaataaggatcggt

SEQ ID NO: 4614 - DNA, 490 bp, Unknown
  Ascusbbf_1718157, encodes 16S rRNA
agagtttgatcatggctcaggacaaacgctggcggcgtgcataacacatgcaagtcgaacgagattgtaggaaatggagtcttcggacaaagctttttacatgaaagtggcgaacgggtgagtaacacgtgagatacctgcccttcacagtgggatagccgttggaaacgacgattaataccgcatgagattgtagtatcgcatgatatagcaattaaagattttatcggtgaaggatggtctcgcgtctgattagctagttggtggggtaaaggcctaccaaggcgacgatcagtagccgatctgagagggtgtacggccacattgggactgagacacggcccaaactcctacgggaggcagcagtggggaattttgcacaatgggggaaaccctgatgcagcgacgccgcgtgaatgaagaaggccttcgggttgtaaagttctgtccttggtgaagataatgacagtaaccaagaagaaagccccgg

SEQ ID NO: 4615 - DNA, 490 bp, Unknown
  Ascusbbf_991045, encodes 16S rRNA
agagtttgatcctggctcaggatgaacgctggcggcgtgcttaacacatgcaagtcgagcggatcttttacttcggtaaaagatcagcggcggacgggtgcgtaacatgtgggtaacctgcccttgtcaccgggataacacactgaaaagtgtgctaataccggataacatcccttttaggcatctttaggggatcaaagaacttcggacaaggatgggcccgcatctgattagctagttggtaaggtaacggcttaccaaggcgacgatcagtagccgacctgagagggtgatcggccacactggaactgagacacggtccagactcctacgggaggcagcagtggggaatcttgcacaatgggcgaaagcctgatgcagcaacgccgcgtgagcgatgaaggccttcgggtcgtaaagctctgtcctatgggaagataatgacggtaccataggaggaagccccggctaactacgtgccagcagccgc

SEQ ID NO: 4616 - DNA, 490 bp, Unknown
  Ascusbbf_1817183, encodes 16S rRNA
agagtttgatcatggctcaggacgaacgctggcggcgtgcttaacacatgcaagtcgaacggagtgaaacgctgaattgatgtcagcttgctgatggattttcttgtttcacttagtggcggacgggtgagtaacgcgtgagtaacctgcctctgagtggggaataacgccctgaaaagagcgctaataccgcataatatacaggagccgcatgactcttgtatcaaagatttatcactgagagatggactcgcgtccgattagcttgttggtggggtaacggcccaccaaggcgacgatcggtagccggactgagaggttgaacggccacattgggactgagacacggcccagactcctacgggaggcagcagtgggggatattgcgcaatgggggaaaccctgacgcagcaacgccgcgtggaggatgacggttttcggattgtaaaccgctgtcaagagggacgaaacatgacggtacctctggagg

SEQ ID NO: 4617 - DNA, 490 bp, Unknown
  Ascusbbf_1304246, encodes 16S rRNA
agagtttgatcctggctcaggatgaacgctggcggcgtgcctaacacatgcaagtcgaacggaactggttttgaagattctcttcggagatgattcgttactagtttagtggcggacgggtgagtaacgcgtgagtaacctgcccttgagagggggataacgttctgaaaagaacgctaataccgcataatactattgaaccgcatgatttaatagccaaaactccggtgctcaaggatggactcgcgtccgattagttagttggcggggtaacggcccaccaagacgacgatcggtagccggactgagaggttgaacggccacattgggactgagacacggcccagactcctacgggaggcagcagtgggggatattgcgcaatgggggaaaccctgacgcagcaacgccgcgtggatgaagacggttttcggattgtaaagtccttttcttggggacgaattttgacggtacccaaggaataagctcc

SEQ ID NO: 4618 - DNA, 484 bp, Unknown
  Ascusbbf_817500, encodes 16S rRNA
agagtttgatcctggctcaggataaacgctggcggcgtgcctaaaacatgcaagtcgaacggacccttcggggttagtggcgaacggctgagtaacacgtgggtgacctgccttcgaacgggggataactgcccgaaagggtggctaataccgcagatgtcgatgcttcggtgtgtcgactgaaccgaatcagggttcggagaggggcctgcgtccgattagctagttggtggggtaagagcttaccaaggcgacgatcggtagctggtctgagaggatgatcagccagactgggactgcgagacggcccagactcctacgggaggcagcagttaggaattttgggcaatgggcgaaagcctgacccagcaacgccgcgtgggtgaagaaggccttcgggtcgtaaagcccttttcccagggaagatgatgacggtacctggggaatcagccccggctaactacgtgccagcagccgcggtaat

SEQ ID NO: 4619 - DNA, 490 bp, Unknown
  Ascusbbf_447632, encodes 16S rRNA
agagtttgatcctggctcagagtgaacgctggcggcgtggttaagacatgcaagtcgaacgggactttaggtgtagcaatacgtttaaagtctagtggcgaacgggtgagtaatacgtgagcaatctgccctaaagcgggggataattcgccgaaaggtgaactaataccgcatgtggtccttggcggcatcgccgaggcactaaagcttgtaacggcactttaggaggagctcgcggcctatcagcttgttggcggggtaacagcccaccaaggctaagacgggtaactggtctgagaggatgatcagtcacactggaactgagacacggtccagacacctacgggtggcagcagtttcgaatcattcacaatgggcgcaagcctgatggtgcgacgccgcgtgagggatgaaggtcctcggattgtaaacctctgtcgatagggactaaacgctgcatgcataatgcagcctgaattaacctatggag

SEQ ID NO: 4620 - DNA, 196 bp, Unknown
  Ascusbbf_1521274, encodes 16S rRNA
agagtttgatcctggctcaggggagactggacggcggtgaccgacacccgcgacgtcgatgagggcgcctcgaaggtcaaggtgacggagctgtcggccgaccagaccgccaacagcctcgacgacatcgccggcgccgtcgtcaacaacgacttcctgaagaacgccggactcgtcggccagcagccgcggtaat

SEQ ID NO: 4621 - DNA, 490 bp, Unknown
  Ascusbbf_1436094, encodes 16S rRNA
agagtttgatcctggctcaggatgaacgctggcggcgtgcctaacacatgcaagtcgaacggaaaggattcttcggaattctttcagtgtcggacgggtgagtaacgcgtgggtaacctgccccatacaggtgaacaacagctgtaaacggctgctaataccgcataagcgcacagtgctgcatggtacagtgtgaaaagattttatcggtatgggatggacccgcgtctgattagctcgttgtaggggtaacggcccaccaagtcgacgatcagtagcctacctgagagggtgaccggcaacattgggaatgcgacacggccaaaattcctacggggggcagaagtgggggatattgcacaatgggcgaaagcctgatgcagcgacgccgcgtgagtgaggaagtatttcggtatgtaaagctctatcagcagggaagaaaatgacggtacctgactaagaagccccggctaactacgtgccagcagcc

SEQ ID NO: 4622 - DNA, 490 bp, Unknown
  Ascusbbf_1446114, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcctcgttggttacggatgggcacgcttgacattagctagttggtagggtaactgcttaccaagtcgacgatgtctaggggagctgagaggcttatcccgctcactggtactgcgacacggaccagacacctacgggaggaagcagtgaggaatattggtcaatggacggaagtccgaaccagccatgccgcgtggaggaagaaggtcctatgggttgtaaactccttttgttcgagagtaataagggctttgcgaagcccgatgagagtatcggacgaataagc

SEQ ID NO: 4623 - DNA, 343 bp, Unknown
  Ascusbbf_378190, encodes 16S rRNA
agagtttgatcctggctcagattgaacgctggcggcaggcctaacacatgcaagtcgaacggtaacaggaaacagcttgctgtttcgctgacgagtggcggacgggtgagtaatgtctgggaaactgcctgatggagggggataactactggaaacggtagctaataccgcataacgtcgcaagaccaaagagggggaccttcgggcctcttgccatcggatgtgcccagatgggattagctagtaggtggggtaacggctcagtaccgttcgaatagggcggtaccttgacggtacctaaccagaaagccacggctaactacgtgccagcagccgcggtaat

SEQ ID NO: 4624 - DNA, 482 bp, Unknown
  Ascusbbf_457901, encodes 16S rRNA
agagtttgatcctggctcagaacgaacgctggcggcacgcttaacacatgcaagtcgaacgagattacgggttcgctcgtaatttagtggcgcacgggtgaggaacgcgtgactacctgcctgttgatggtggataactccgggaaactggagctaatacagcatgagctcgagagaggaaagacgaaagtcgtcgacagaaggggttgcgtctgattaggtagttggtagggtaaaggcctaccaagccgatgatcagtagctggtctgagaggatggtcagccacactggaactgagacacggtccagactcctacgggaggcagcagtggggaatattggacaatgggcgaaagcctgatccagcgatgccgcgtgagtgatgaaggccttagggttgtaaagctcttttgacagggacgatgatgacggtacctgtagaataagcaccggctaactctgtgccagcagccgcggtaat

SEQ ID NO: 4625 - DNA, 470 bp, Unknown
  Ascusbbf_1519326, encodes 16S rRNA
agagtttgatcatggctcaggattaacgctggcggtgtgcctaacacatgcaagtcgagcgccccttcgggggagcggcggacggctgagtaacacgttggtacctgccccaaacccgggaataagcgctggaaacggcgtctaatgcccgatagttctcttcggagtaaagatttatcggtttgggaggggcctgcgcccgattagcttgttggtgaggtaacggctcaccaaggctctgatcggtaggtggtctgagaggatgatcacccagactgggactgagacacggcccagactcctacgggaggcagcagtgaggaatcttgcacaatgggggaaaccctgatgcagcaacaccgcgtggaggaagaatgccttcgggttgtaaactccttttatctaggacgaacattgacggtactagatgaataaggactggctaaccacgtgccagcagccgcggtaat

SEQ ID NO: 4626 - DNA, 481 bp, Unknown
  Ascusbbf_947502, encodes 16S rRNA
agagtttgatcctggctcaggataaacgctggcggcgtgcctaaaacatgcaagtcgaacggacacttcggtgttagcggcgaacggctgagtaacgcgtgggtgacctgccttcgaacgggggataactgcccgaaagggtggctaataccgcagatgttgcggcttcggtgctgtaactgaacttccggggttcggagaggggcctgcgcccgattagctagctggtggggtaacggcctaccagggcgacgatcggtagctggtctgagaggatgatcagccagactgggactgcgaacggcccagactcctacgggaggcagcagttaggaattttgggcaatgggcgaaagcctgacccagcaacgccgcgtgggtgatgaaggccttcgggtcgtaaagcccttttcccagggaagatgatgacggtacctggggaatcagccccggctaactacgtgccagcagccgcggtaat

SEQ ID NO: 4627 - DNA, 254 bp, Unknown
  Ascusbbf_506698, encodes 16S rRNA
agagtttgatcatggctcaggacgaacgctggtggcgtgcttaacacatgcaagtcgaacgaggctgatatttagcttgctattttgatgccgagtggcaaacgggtgagtaacgcgtagacaacctgccgcaagggtttcggctcgtaaagctctgttgatggggacgaatgtgcgaaatgcgaacagtttttcgcgatgacggtacccgtcgaggaagccacggctaactacgtgccagcagccgcggtaat

SEQ ID NO: 4628 - DNA, 470 bp, Unknown
  Ascusbbf_1549508, encodes 16S rRNA
agagtttgatcatggctcagaacgaacgctggcggcaggcctaacacatgcaagtcgaacgaagtcttcggacttagtggcgcacgggtgagtaacacgtgggaacgtacctttcagtggggaataacctcgggaaactgaggctaataccgcatacgcccttcgggggaaagatttatcgctgaaggatcggcccgcgtccgattagctagttggtgaggtaatggcttaccaaggcaacgatcggtacctggtctgagaggatgatcagccacactgggactgagacacggcccagactcctacgggaggcagcagtggggaatattggacaatgggcggaagcctgatccagccatgccgcgtgaatgatgaaggccttagggttgtaaagttctttcggtcacgacgatgatgacggtagtgacagaagaagccccggctaacttcgtgccagcagccgcggtaat

SEQ ID NO: 4629 - DNA, 490 bp, Unknown
  Ascusbbf_1044567, encodes 16S rRNA
agagtttgatcatggctcaggataaacgctggcggcgcacataagacatgcaagtcgaacggacttaactatttgcttgcaaatagagcggttagtggcggactggtgagtaacacgtaagaaatctgcctatcagtggggaataacagtgagaaatcattgctaataccgcatatgccataagaatcgcatgattctagtgggaaaggagcaattcgctgatagatgagcttgcgtctgattagctagttggtggggcaacggcctaccaaggcaacgatcagtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaagtccttttgttggggacgaaatttgacggtacccaacgaataagctccggctaactacgt

SEQ ID NO: 4630 - DNA, 490 bp, Unknown
  Ascusbbf_1633875, encodes 16S rRNA
agagtttgatcatggctcagaataaacgctggcggcgtgcttaacacatgcaagtcgagcgcgaaaggccttcgggctgagtaaagcggcgaacgggtgagtaacgcgtgggaatcagcctttcagtgaggaataccctcgagaaatcgaggttaatactgcatacgtcttgaaaaagagaaagatggctctttgagctgtcgctgaaagatgagctcgcgtactattagctagttggtggggtaatggcctaccaaggcaatgatggttagccggcctgagagggtgtacggccacactggaacttagacacggtccagactcctacgggaggcagcagtgaggaatattgcgcaatgggcgaaagcctgacgcagcaacgccgcgtggaggatgaaggtcttaggattgtaaacttctgttaagtgggaagaaatgtccatgagaaatatgcatggaagatgacggtaccattagagaaagcaccggc

SEQ ID NO: 4631 - DNA, 490 bp, Unknown
  Ascusbbf_1593001, encodes 16S rRNA
agagtttgatcatggctcagattgaacgctggcggcaggcttaacacatgcaagtcgagcgggaataggtagcttgctactgatttctagcggcggacgggtgagtaatacttaggaatctgcctattagtgggggacaacatctcgaaagggatgctaataccgcatacgccctacgggggaaaggaggggatcacttgtgacctttcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatggggggaaccctgatccagccatgccgcgtgtgtgaagaaggccttatggttgtaaagcactttaagcgaggaggaggagctctaggttaataccttagaagcttggacgttactcgcagaataa

SEQ ID NO: 4632 - DNA, 490 bp, Unknown
  Ascusbbf_1542424, encodes 16S rRNA
agagtttgatcctggctcaggatgaacgctagcgggaggcttaacacatgcaagtcgagcggtataatcccttcgggggttagagagcggcgcacgggtgagtaacgcgtatgcaacctaccttttaccggggaatagcccggagaaatttggattaatgccccatggttccttatgtctgcatggatttaaggataaagttgaggcggtaaaagatgggcatgcgtgacattagctagttgggggggtaacggcccaccaaggctacgatgtctaggggttctgagaggatgatcccccacactggtactgagacacggaccagactcctacgggaggcagcagtgaggaatattggtcaatgggcgcaagcctgaaccagccatcccgcatgaaggaagactgtactatgtattgtaaacttcttttctgcaagaagaacgtgccctacgtgtagggtagtgacggtattgcaggaataagcatcggc

SEQ ID NO: 4633 - DNA, 490 bp, Unknown
  Ascusbbf_599226, encodes 16S rRNA
agagtttgatcctggctcaggatgaacgctagcggcaggcttaacacatgcaagtcgaggggtagaattagcttgctaatttgagaccggcgcacgggtgcgtaacgcgtatgcaatctgcctctcactgggggatagcccggagaaatccggattaataccccatggtattttagggtggcatcaccttattattaaagatttatcggtgagagatgagcatgcgtcccattagttagttggtgtggtaacggcacaccaagacgatgatgggtaggggtcctgagagggagatcccccacactggtactgagacacggaccagactcctacgggaggcagcagtgaggaatattggtcaatggacgcaagtctgaaccagccatgccgcgtgcaggatgacggtcctatggattgtaaactgcttttgtacgagaagaaacctttctacgtgtagaaagctgacggtatcgtaagaataaggatcggc

SEQ ID NO: 4634 - DNA, 490 bp, Unknown
  Ascusbbf_358040, encodes 16S rRNA
agagtttgatcctggctcaggatgaacgctggcggcgtgcctaacacatgcaagtcgagcgtgaagttttggaacgacacttcggtagagtgaagaaacggaaagcggcggacgggtgagtaacgcgtaggtaacctgccccatacacagggatagcctagggaaacctggattaatacctgatgatgcgaaggagtcacatggctttttcgccaaagatttatcggtatgggatggacctgcgtctgattagttagttggtgaggtaacggctcaccaaggcagcgatcagtagccgacctgagagggtaatcggccacattggaactgagacacggtccaaactcctacgggaggcagcagtggggaatattgcacaatgggcgcaagcctgatgcagcaacgccgcgtgagcgaagaaggtcttcggatcgtaaagctctgtccttagggaagaaacaaatgacggtacctgaggaggaagccccgg

SEQ ID NO: 4635 - DNA, 468 bp, Unknown
  Ascusbbf_1733358, encodes 16S rRNA
agagtttgatcatggctcagaacaaacgctggcggcaggcctaacacatgcaagtcgaacgcaccttcgggtgagtggcgcacgggtgagtaacacgtgggaatgtaccctttggttcggaataacgtttggaaacgaacgctaataccggatgagccctacgggggaaagatttatcgccaaaggagcagcccgcgtctgattaggtagttggtggggtaaaggcctaccaagccgacgatcagtagctggtctgagaggatgatcagccacactgggactgagacacggcccagactcctacgggaggcagcagtggggaatattggacaatgggcgcaagcctgatccagccatgccgcgtgagtgatgaaggccttcgggttgtaaagctctttcgcacacgacgatgatgacggtagtgtgagaagaagccccggctaacttcgtgccagcagccgcggtaat

SEQ ID NO: 4636 - DNA, 490 bp, Unknown
  Ascusbbf_1640611, encodes 16S rRNA
agagtttgatcctggctcaggacgaacgctggcggcgtgcttaacacatgcaagtcgaacgaggatcagttggaagcttgcttttgactgattcgagtggcggacgggtgagtaacgcgtgaacaatctgtctcatacagggggataacgcatcgaaagatgtgctaataccgcataggaccacagagccgcatggcagaggggtgaaaggagcaatccggtatgaggtgagttcgcgtctgattagatagttggtgaggtaacggcccaccaagtcaacgatcagtagccgacctgagagggtgatcggccacattgggactgagacacggcccagactcctacgggaggcagcagtggggaatattgggcaatgggcgaaagcctgacccagcaacgccgcgtgaaggaagaaggttttcggatcgtaaacttctgtccttggtgaagaggaagagacggtagccaaggaggaagccccggctaacta

SEQ ID NO: 4637 - DNA, 470 bp, Unknown
  Ascusbbf_642526, encodes 16S rRNA
agagtttgatcatggctcaggacgaacgctggcggcgtgcttaacacatgcaagtcgagcgcccacttcggtgggagcggcagacgggtgagtaacgcgtgggaatctacccagctctacggaataacccagggaaacttggactaataccgtatacgtccttcgagagaaagatttatcggagttggatgagcccgcgttggattagctagttggtggggtaatggcctaccaaggcgacgatccatagctggtctgagaggatgatcagccacactgggactgagacacggcccagactcctacgggaggcaacagtggggaatattggacaatgggcgaaagcctgatccagccatgccgcgtgagtgatgaaggccctagggttgcaaagctctttcaacggtgaagataatgacggtaaccgtagaagaagccccggctaacttcgtgccagcagccgcggtaat

SEQ ID NO: 4638 - DNA, 490 bp, Unknown
  Ascusbbf_1480923, encodes 16S rRNA
agagtttgatcctggctcagggcgaacgctggcggcgtggattaggcatgcaagtcgagcgacagaccttcgggttatggagcggcgaacgggtgagtaacacgtgaataacctaccctctcattccggataattggctgaaaagccttgtaatacgggggaggttccagattgggcatcttaactggaacgaacaagcaattggtgcgaggcggggttcgcggattatcagctagttggtgaggtaatggctcaccaaggctacgacgattagctggtctgagaggatggtcagccacattggaactgagatactgtccagactcctacgggaggctgcagtcgagaatcttgggcaatgcacgaaagtgtgacccagcgacgccgcgtgcaggatgactgccctctgggttgtaaactgcttttacgggagaagaatcaatgacggtatcccgtgaataagccacggctaactacgtgccagcagccg

SEQ ID NO: 4639 - DNA, 490 bp, Unknown
  Ascusbbf_1076811, encodes 16S rRNA
agagtttgatcctggctcaggacgaacgctggcggcgtgcctaacacatgcaagtcgaacggagacgaggcataagcttcccttcgggggagccgtttcgtcttagtggcggacgggtgagtaacgcgtgacaacctgccgtatgctgggggacaacagcgggaaactgctgctaataccgcataagccggggagggggcatccccatcccgggaaagatttatcggcatacgaggggtccgcgtccgattagccagttggcggggtgacggcccaccaaagcgacgatcggtagccggcctgagagggcggacggccacattgggactgagatacggcccaaactcctacgggaggcagcagtgggggatattgcacaatcgggggaaccctgatgcagcgacgccgcgtgggcgaagaagcgcttcggcgcgtaaagccctttcagcgggagggaaggagacggtacccgcagaagaagcaccggcta

SEQ ID NO: 4640 - DNA, 490 bp, Unknown
  Ascusbbf_1674819, encodes 16S rRNA
agagtttgatcctggctcagattgaacgctggcggcatgcctaacacatgcaagtcgaacggcagcacagaggagcttgctccttgggtggcgagtggcggacgggtgagtaatgcatcgggacctacccagacgtgggggataacctcgggaaaccgggactaataccgcatacgtcctacgggagaaagcgggggaccttcgggcctcgcacggttggacggaccaatgtgcgattagctagttggtaaggtaatggcttaccaaggcgacgatcgctagctggtctgagaggatgatcagccacactgggactgagacacggcccagactcctacgggaggcagcagtggggaatattggacaatgggcgaaagccagatccagcaatgccgcgtgtgtgaagaaggccctcgggttgtaaagcacttttatcaggaacgaaataccacgggttaataacctatggggctgacggtacctgaggaat

SEQ ID NO: 4641 - DNA, 490 bp, Unknown
  Ascusbbf_451363, encodes 16S rRNA
agagtttgatcctggctcagattgaacgctggcggcaggcctaacacatgcaagtcgagcggtaacaggggagcttgctcccgctgacgagcggcggacgggtgagtaacgcacaggaatctacccagtagcgggggatagcccggggaaactcggattaataccgcatacgccctacgggggaaagcaggggatctgatcttcggaaaggaccttgcactattggaagagcttgtgttggattagcttgttggtagggtaaaggcctaccaaggcgacgatccatagctggtctgagaggatgatcagccacaccggaactgagacacggtccggactcctacgggaggcagcagtggggaatattggacaatgggggcaaccctgatccagccatgccgcgtgtgtgaagaaggccttcgggttgtaaagcactttaagttgggaggaaggggtgttgattaatactcaacatcattgacgttaccaa

SEQ ID NO: 4642 - DNA, 227 bp, Unknown
  Ascusbbf_410106, encodes 16S rRNA
agagtttgatcctggctcagcatatcgctgatggctttttcctgcgggcgcttctgcgaccactccgccgtacgtgtatcaacagcagagtcatccggcttttcagccgccgtctgctctgccggagcactgccagctgcagtatcggcagctgcagacttatcggcctgcggctgcgcagcagcatcagcagctgcctcaacagttgcgccagcagccgcggtaat

SEQ ID NO: 4643 - DNA, 490 bp, Unknown
  Ascusbbf_1815676, encodes 16S rRNA
agagtttgatcctggctcaggatgaacgctgacagaatgcttaacacatgcaagtctttggcaaatctgtgcttgcatagcctagccaaggcggacgggtgagtaacgcgtaaagaacttaccctgcagacagggataacagacggaaacgactgataatacctgatataattgccagcacgcatgtgcccggcaatgaaaagtaatgctgcaggagagctttgcgtcctattagcttgttggtgaggtaacggctcaccaaggcgatgataggtagccggcctgagagggtgaacggccacaaggggactgagacacggcccttactcctacgggaggcggcagtggggaatattggacaatgggggcaaccctgatccagcaattctgtgtgcacgaagaaggttttcggattgtaaagtgctttcagcagggaagaagaaaagtgacggtacctgcagaagaagcgacggctaaatacgtgccagca

SEQ ID NO: 4644 - DNA, 490 bp, Unknown
  Ascusbbf_1820555, encodes 16S rRNA
agagtttgatcctggcttaggatgaacgctggcggcgtgcttaacacatgcaagtcgaacggaatctatctgcggcggccttcgggcttaagcgtttagatttagtggcgaacgggtgagtaacacgtgagtaacctgcctatttccgggggataacaacgggaaaccgttgctaataccgcatatactatcttgacggcatcgtttagataggaaagatttatcgggaatagaggggctcgcgtccgattagttagttggtgaggtaaaggctcaccaagaccgcgatcggtagccggactgagaggttgaacggccacattgggactgagacacggcccagactcctacgggaggcagcagtggggaatattgggcaatgggcggaagcctgacccagcaacgccgcgtgaaggatgaaggttttcggattgtaaacttctttggccagggacgataatgacggtacctggagaacaagccacggcta

SEQ ID NO: 4645 - DNA, 490 bp, Unknown
  Ascusbbf_961622, encodes 16S rRNA
agagtttgatcctggctcagagtgaacgctggcggcgtgcctaacacatgcaagtcgaacggagtaaattagcttgctagtttacttagtggcgcacgggtgagtaatatatagttaatctgccccttagaggaggacaacatttggaaacgaatgctaatactccatactcctttttaacataagttaaatcgggaaacgaattttgctaagggatgagactatattgtatcagctagttggtaaggtaagagcttaccaaggctttgacgcataactggtctgagaggatgaacagtcacattggaactgagacacggtccaaactcctacgggaggcagcagtggggaatattgcgcaatgggggaaaccctgacgcagcaacgccgcgtggaggatgacacttttcggagcgtaaactccttttctttgggaagaattatgacggtaccaaaggaataagcaccggctaactccgtgccagcagcc

SEQ ID NO: 4646 - DNA, 490 bp, Unknown
  Ascusbbf_1184473, encodes 16S rRNA
agagtttgatcctggctcaggacgaacgctggcggcgtgcttaacacatgcaagtcgaacgagaatcaccggaaggagttttcggacaacggaaggtgaggaaagtggcggacgagtgagtaacacgtaggaacctgcctggtaatggtggatagcttcgggaaactggaggtaatacagcatgagctcgagagaggaaaggccttagggtcgttaccagaggggcctgcggatgattaggtagttggtggggtaagagcctaccaagccgacgatcaatagctggtctgagaggatgatcagccacactggaactgagatacggtccagacttctactggaggcagtagtggggaatattggacaatggggggaaccctgatccagcgatgctgcgtgagtgaagaaggccttagggttgtaaagctcttttgacagggacgatgatgacggtacctgtagaataagcaccggctaactctgtgccagc

SEQ ID NO: 4647 - DNA, 468 bp, Unknown
  Ascusbbf_1537048, encodes 16S rRNA
agagtttgatcatggctcagaacgaacgctggcggcatgcctaacacatgcaagtcgaacgcaccttcgggtgagtggcggacgggtgagtaacgcgtgggaacctgcctatcagtacggaataaccaagggaaactctggctaataccgtatacgtccttcgggagaaagatttatcgctgatagatgggcccgcgtccgattagcttgttggcggtgtaatggaccaccaaggcgacgatcggtagctggtcttagaggatgatcagccacactgggactgagacacggcccagactcctacgggaggcagcagtggggaatattggacaatgggcgaaagcctgatccagcaatgccgcgtgagtgatgaaggccttagggttgtaaagctcttttaccagggaagatgatgactgtacctggagaataagccccggctaactccgtgccagcagccgcggtaat

SEQ ID NO: 4648 - DNA, 490 bp, Unknown
  Ascusbbf_1621589, encodes 16S rRNA
agagtttgatcctggctcagattgaacgctggcggtatgcttaacacatgcaagtcgaacggcagcacgagagagtttactcttttggtggcgagtggcggacgggtgagtaatacataggaatctgccttatagtttgggataactactcgaaagagtggctaataccggatgtggactacggtttaaagcaggggatcttcggaccttgcgctataagatgagcctatgcaagattagctagttggtgaggtaaaggctcaccaaggcgacgatctttagctggtctgagaggatgatcagccaaactgggactgagacacggcccagactcctacgggaggcagcagtggggaatattggacaatgggcggaagcctgatccagcaataccgcgtgtgtgaagaaggccttcgggttgtaaagcacttttgtcagggagaatgctagtagaggttaataccctttgctattgatgttacctgaagaa

SEQ ID NO: 4649 - DNA, 490 bp, Unknown
  Ascusbbf_1095479, encodes 16S rRNA
agagtttgatcatggctcaggacgaacgctggcggcgtgcttaacacatgcaagtggagcgacgaaccagggcttgccctggggcagagccgcgaacgggtgagtaacacgtgggcaacctgccccgatgactgggacaacccgaggaaactcgggctaataccggatgtgctccctcacatcagtgagacgagtaaaggaagcttcggcctccgcatcgggatgggcccgcggcccattagcttgttggtggggtaacggcccaccaaggcaacgatgggtagctggtctgagaggacgatcagccacactgggactgagacacggcccaaactcctacgggaggcagcagtggggaatattgcacaatgggggaaaccctgatgcagcgacgccgcgtgagtgaagaagtatttcggtatgtaaagctctatcagcagggaagaagatgacggtacctgcagaagcagccccggctaactacgtgcca

SEQ ID NO: 4650 - DNA, 490 bp, Unknown
  Ascusbbf_856132, encodes 16S rRNA
agagtttgatcctggctcaggatgaacactaacgacaggcttaacacatgcaaatcgaggggcagcgcgggagtgacaacactcctaacggcgaccggcgcactaataaataacacatatgcaacctgccccggacaggggaataaacccagaaaactgggcctaataccccatagacctaaagggtacatgccttcaaaatggaagatccgtcggtccgaaataagcatgcggcgcattaactagttggcggagcaacaacccaccaagacaacaatacgtaggggttctaaaagaaaaatcccacacactggtactaaaacacagaccagactcctacaggaggcagcagtgaggaatattggtcaatggtcgggagactaaaccagccaagtcgcgtgcgggataaaggccctccgggtcgtaaaccgctttagccggggagtaacgtgggggacgtgtcccccagtgagagtacccggagaataag

SEQ ID NO: 4651 - DNA, 484 bp, Unknown
  Ascusbbf_812679, encodes 16S rRNA
agagtttgatcctggctcagaacgaacgctggcggcatgcttaacacatgcaagttgaacgcagaataggacttcggttctattgctgagtagcaaacgggtgagtaacgcgtgggaatctacctttttgtgggggataactgagggaaacttcagctaataccgcataagctctacggaggaaaggcttcggccgcaagaagaggagcccgcgtcagattaggtagttggtagggtaaaagcctaccaagccaatgatctgtagctggtctgagaggatgatcagccacactgggactgagacacggcccagactcctacgggaggcagcagtggggaatattggacaatgggggaaaccctgatccagcaatgccgcgtgaatgaagaaggccttagggttgtaaagttctttcacctgtgacgataatgacggtagcaagagaagaagccccggctaactccgcgccagcagccgcggtaa

SEQ ID NO: 4652 - DNA, 490 bp, Unknown
  Ascusbbf_1363581, encodes 16S rRNA
agagtttgatcctggctcaggatgaacgctggcggcgtgcttaacacatgcaagtcgaacgaagacatctgagtgcttgcacttggatggactgagtggcggacgggtgagtaacgcgtgagcaacctgcccttcagagggggatagcgtttggaaacgaacggtaataccgcataacgtattttaaccgcatgattgaaataccaaaactacggtgctgaaggatgggctcgcgttggattagatagttggtggggtaacggcctaccaagtcgacgatccatagccggactgagaggttgaacggccacattgggactgagacacggcccagactcctacgggaggcagcagtggggaatattgcacaatgggggaaaccctgatgcagcaacgccgcgtgaaggaagacggttttcggattgtaaacttctgttcttagtgaagaataatgacggtagctaaggagcaagccacggctaactacgtg

SEQ ID NO: 4653 - DNA, 483 bp, Unknown
  Ascusbbf_712413, encodes 16S rRNA
agagtttgatcctggctcagaacgaacgctggcggcaggcctaacacatgcaagtcgaacgagcacgacccagcttgctgggtacggctagtggcagacgggtgcgtaacacgtgggaaccttcccttgagtcaggaataacagttggaaacgactgctaatacctgatatcccctgagggggaaagatttatcgctcaaggatgggcccgcggcagattagctagttggtagggtaacggcctaccaaggcgacgatctgtagctggtctgagaggatgatcagccacactggaactgagacacggtccagactcctacgggaggcagcagtgaggaatattggacaatgggcgaaagcctgatcagccatgccgcgtgagtgaagaaggccttagggttgtaaaactcttttagcagggaagataatgacggtacctgcagaaaaagctccggctaactccgtgccagcagccgcggtaat

SEQ ID NO: 4654 - DNA, 490 bp, Unknown
  Ascusbbf_1564437, encodes 16S rRNA
agagtttgatcctggctcagattgaacgctggcggcaggcttaacacatgcaagtcgagcggagcgagggtgcttgcaccttagcttagcggcggacgggtgagtaatgcttaggaatctgcctattagtgggggacaacgtttcgaaagggacgctaataccgcatacgccctacgggggaaagcaggggatcacttgtgaccttgtgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattggacaatgggggcaaccctgatccagccatgccgcgtgtgtgaagaaggccttttggttgtaaagcactttaagtggggaggaggctctcgatgctaatatcatcgaagagtggacgttaccacagaataagc

SEQ ID NO: 4655 - DNA, 473 bp, Unknown
  Ascusbbf_600318, encodes 16S rRNA
agagtttgatcctggctcagagcgaacgctggcggcaggcttaacacatgcaagtcgaacgggcaccttcgggtgtcagtggcagacgggtgagtaacacgtgggaacgtgtcctccggtccgggataactcatggaaacgtgagctaataccggatacgtgcttatggcagaaaggtttactgccggaggatcggcccgcgtctgattagctagttggtggggtaacggcctaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgacggccttagggttgtaaagctcttttctccgggacgataatgacggtaccggaggaataagccccggctaacttcgtgccagcagccgcgataat

SEQ ID NO: 4656 - DNA, 490 bp, Unknown
  Ascusbbf_924478, encodes 16S rRNA
agagtttgatcctggctcaggacgaacgctggcggcgtgcttaacacatgcaagtcgagcggaaaggccttacggggtactcgagcggcgaacgggtgagtaacacgtgagtgacctgcccttcacttggggataagccttggaaacggggtctaatacccaatattcactgtctgttgcatgacaggtggtggaaagcttttgtggtggaggatgggctcgcggactatcagcttgttggtggggtgatggcctaccaaggctttgacggttagccggcctgagagggtgtccggccacactgggactgagacacggcccagactcctacgggaggcagcagtggggaatattgcgcaatgggcggaagcctgacgcagcgacgccgcgtgagggatgacggccttcgggttgtaaacctctttcgacaccgacgaagcgaaagtgacggtaggtgtagaagaagcaccggccaactacgtgccagcag

SEQ ID NO: 4657 - DNA, 458 bp, Unknown
  Ascusbbf_500004, encodes 16S rRNA
agagtttgatcctggctcagaataaatgctatcggtatgcttaacacatgcaagttaaatgttaaaaacatagcgaacgggtgagtaacacgtgaattatctaccttttaattcaggataattatttttataaaaatactgaataaataaattaaagttttttaacgttagaagatgagtttgcgcaagattatggtagttggtagtttaaaagactaccaagcctattatctttagctgatttgaaagaatgatcagccacattgggactgagacacggcccaaacttttttaaaggcagcagtggggaattttggacaatgagcgaaagcttgatccagcaacaccgagtgagtgaaggaggctaattaggttgtaaagctctttcattaaggaggagaatgacagtacttaaaaaagaagttccggctaatacccgtgccagcagccgcggtaat

SEQ ID NO: 4658 - DNA, 490 bp, Unknown
  Ascusbbf_1113633, encodes 16S rRNA
agagtttgatcctggctcaggacgaacgctggcggcgtgcttaacacatgcaagtcgagcggtaaggctccttcgggagtacacaagcggcgaacgggtgagtaacacgtgagcaatctgcccttcacttcggaataaccccgggaaactggggctaataccggataccaaccacaggtggcatcatctgcggttgaaagccccggcggtgaaggatgagctcgcggcctatcagctagttggtgaggtaaaggcccaccaaggcaacgacgggtagccggcctgagagggtgaccggccacactgggactgagacacggcccagactcctacgggaggcagcaatggggaatattggacaatgggcgaaagcctgatccagcaacgccgcgtgagggatgacggccttcgggttgtaaacctctttcatccacgacgaagcgcaagtgacggtagtggaacaagaagcaccggccaactacgtgccagc

SEQ ID NO: 4659 - DNA, 490 bp, Unknown
  Ascusbbf_469419, encodes 16S rRNA
agagtttgatcatggctcagattgaacgctggcggcaggcttaacacatgcaagtcgagcgggggaaggtagcttgctaccggacctagcggcggacgggtgagtaatgcttaggaatctgcctattagtgggggacaacatctcgaaagggatgctaataccgcatacgtcctacgggagaaagcaggggatcttcggaccttgcgctaatagatgagcctaagtcggattagctagttggtggggtaaaggcctaccaaggcgacgatctgtagcgggtctgagaggatgatccgccacactgggactgagacacggcccagactcctacgggaggcagcagtggggaatattgggcaatgggcgaaagccttacccagcaatgccgcgtgaatgattgaaggtcttcggattgtaaagttcttttattggtgacgaacaaaatgacggtagccgatgaataagccccggctaactacgtgccagcag

SEQ ID NO: 4660 - DNA, 490 bp, Unknown
  Ascusbbf_1664916, encodes 16S rRNA
agatttgatcatggctcaggatgaacgctagctacaggcttaacacatgcaagtcgaggggcagcatgaaggtagcttgctacctttgatggcgaccggcgcacgggtgcgtaacgcgtatccaatctgccgcttactcggggccagccttgcgaaagtaagattaatacccgatgttgtgcattaatcgcatgattggtgtaccaaagattaatttcggtaagcgatgaggatgcgtccgattagttagttggcggggtaacggcccaccaaggcgacgatcggtaggggttctgagaggatgatcccccacactggtactgagacacggaccagactcctacgggaggcagcagtgaggaatattggtcaatggccgagaggctgaaccagccaagtagcgtgcaggatgactgccttacaggttgtaaactgcttttatgcgggggtaaagtgaggcacgtgtgcctttttgcaagtaccgcatgaa

SEQ ID NO: 4661 - DNA, 490 bp, Unknown
  Ascusbbf_903864, encodes 16S rRNA
agagtttgatcctggctcagaacgaacgctggcggcaggcttaacacatgcaagttgagcgggaactgagggtagcttgctacttgaggggagagcagcgcattggtgagtaacacgtgggaacataccttttggtgggggacaacagttggaaacgactgctaataccgcataagccctaagggggaaagattaattgccgaaagattggcccgcggaagattaggtagtaggtggggtaacggcctacctagccgacgatctatagctggtctgagaggacgatcagccacattggaactgagacacggtccagactcctacgggaggcagcagtgaggaatattgggcaatggaggaaaccctgaacgagcaatgccgcgtgaaggatgacggtcctatggattgtaaacttctgttgttagggaagaattacctatgtaggaaatgacataggagtgacggtacctttcaagaaagctccggctaa

SEQ ID NO: 4662 - DNA, 490 bp, Unknown
  Ascusbbf_1421893, encodes 16S rRNA
agagtttgatcctggctcaggacgaacgctggcggcgtgcttaacacatgcaagtcgaacggtgaacctgcttcggtgggggatcagtggcgaacgggtgagtaacacgtgggcaacctgcccctggctctgggataactccaagaaattggggctaataccggatgtgaccgctgaccgcatggtctggtggtggaaagatttatcggctggggatgggcccgcggcctatcagcttgttggtggggtagtggcctaccaaggcgacgacgggtagccggcctgagagggtgaccggccacactgggactgagacacggcccagactcctacgggaggcagcagtggggaatattgcgcaatgggcggaagcctgacgcagcgacgccgcgtgggggatgacggccttcgggttgtaaacctctttcagtagggacgaagcggaagtgacggtacctacagaagaagcaccggccaactacgtgccagc

SEQ ID NO: 4663 - DNA, 470 bp, Unknown
  Ascusbbf_1267528, encodes 16S rRNA
agagtttgatcatggctcagaacgaacgctggcggcaggcttaacacatgcaagtcgaacgcactcctcggagtgagtggcagacgggtgagtaacgcgtgggaaactacctggtggtctggaataacttggggaaactcaagctaataccggatgtgcccttcgggggaaagatttatcgccattggacgtgcccgcgtcggattagctagttggtgaggtaatggctcaccaaggctacgatccgtagctggtcttagaggatgatcagccacactgggactgagacacggcccagactcctacgggaggcagcagtggggaatattggacaatgggcgcaagcctgatccagccatgccgcgtgagtgatgaaggccttagggttgtaaagctctttcgccggggaagataatgacggtacccggagaagaagccccggctaacttcgtgccagcagccgcggtaat

SEQ ID NO: 4664 - DNA, 490 bp, Unknown
  Ascusbbf_1815330, encodes 16S rRNA
agagtttgatcctggctcaggacgaacgctggcggcgtgcttaacacatgcaagtcgaacgaggtccatgcagtcgcaagactgcggaagacctagtggcgaacgggtgcgtaacacgtgaggaacttgtcccggtctctggaataacaagtggaaacacttgctaataccggatgacgtcggatcatcgcatggtgaactgacgaaagggttaccggatcgggagagcctcgcggcctatcagcttgttggtgaggtaacggctcaccaaggcatcgacgggtagctggtctgagaggatgatcagccacactgggactgagacacggcccagactcctacgggaggcagcagtggggaatcttgcacaatgggcgaaagcctgatgcagcaacgccgcgtgcgggaagaaagccttagggttgtaaaccgctttcagcagggaagaaaatgacggtacctgtagaagaaggtgcggccaactacgtgc

SEQ ID NO: 4665 - DNA, 490 bp, Unknown
  Ascusbbf_1050328, encodes 16S rRNA
agagtttgatcatggctcagaacgaacgctggcggcgtgcctaacacatgcaagtcgaacgagaaagcccttcggggtgagtatagtggcgcacgggtgagtaatgcataggaacgtacctctttgtggggaataacgacgggaaaccttcgctaataccgcatgatgtcgtaagaccaaaggtggcctctacttgtaagctaccgcagagagatcggcctatgtcccattagctagttggcggggtaatagcccaccaaggcaacgatgggtagctggtctgagaggacgatcagtcacactggaactgagacacggtccagactcctacgggaggcagcagtggggaatattgcacaatgggcggaagcctgatgcagcaacgccgcgtgagtgaagaaggatcttggttcgtaaagctctttcggcagggaagaagggtacctaggtaaataatctaggaacttgacggtacctgcataagaagcac

SEQ ID NO: 4666 - DNA, 490 bp, Unknown
  Ascusbbf_792056, encodes 16S rRNA
agagtttgatcctggctcaggacgaacgctggcggcgtgcttaacacatgcaagtcgaacggagctatgttttgaagttcctcggaatgaatttatatagcttagtggcggacgggtgcataacacgtgagtaatctgccctgaagtggggaacaacacaccgaaaggtgtgctaataccgcataacgcagctttgccgcatgacagagctgtcaaagatttatcgctttaggatgagctcgcggccgattaggcagttggcggggtaatggcccaccaaaccgacgatcggtagccggactgagaggttgaccggccacattgggactgagatacggcccagactcctacgggaggcagcagtggggaatattgcgcaatgggggaaaccctgacgcagcaacgccgcgtgaaggatgaaggttttcggatcgtaaacttatgtcttcggggacgagaacggacggtacccgaggaggaagccacggct

SEQ ID NO: 4667 - DNA, 490 bp, Unknown
  Ascusbbf_627053, encodes 16S rRNA
agatttgatcatggctcaggatgaacgctggcggcgtgcctaacacatgcaagtcgaacggggatactttagtagtaataccgaggtattctagtggcggacgggtgagtaacgcgtgagcaacctgcctttcagagggggacaacagctggaaacggctgctaataccgcataatatatttggacggcatcgtctgaatatcaaagatttatcgctgaaagatgggctcgcgtctgattagctagttggtggggtaagagcctaccaaggcgacgatcagtagccggactgagaggttgaacggccacattgggactgagatacggcccagactcctacgggaggcagcagtggggaatattggtcaatgggggaaaccctgaaccagcaacgccgcgtgaaggaagaaggctttcgggttgtaaacttctttgacaggggaagaaaaaaatgactgtaccctgaaaacaagccacggctaactacgtg

SEQ ID NO: 4668 - DNA, 487 bp, Unknown
  Ascusbbf_620403, encodes 16S rRNA
agagtttgatcctggctcaggataaacgctggcggcgtgcttcaggcatgcaagtcgaacgggtagctttgctaccagtggcggacgggtgagtaacacgtaagcaacctgcccagaagtggggaataacccatcgaaaggtgagctaattccgcatatgatggttcctccctggaggggccattaaaggtttcggccgcttctggaggggcttgcgctcgattagctagttggtggggtaaaggcctaccaaggcaacgatcgatagctggtctgagaggacggtcagccacacggggactgagatacggccccgactcctacgggaggcagcagctaggaatcttgggaatgggcgaaagcctgacccagcaacgccgcgtgggcgatgaaggctctagggtcgtaaagcccttttgtgggggacgatagtgacggtaccccacgaataagccacggctaactacgtgccagcagccgcggtaat

SEQ ID NO: 4669 - DNA, 478 bp, Unknown
  Ascusbbf_1111155, encodes 16S rRNA
agagtttgatcctggctcagattgaacgctggcggcatggttaaagcatgcaagtcgaacgagaaccaccttcgggtggggacagtggcgaaagggcgaggaacgcgatcgaacgtgccccgaggcgggggatggcgtcgggaaaccggcggtaataccccatgtgctctacggaggaaaggtttaccaccttgggagcggcgatcgtcctatcaggttgttggtgaggtaacggctcaccaagcctaagacgggtagcgggtgtgagagcatgacccgccgcatcgggactgagacactgcccggactcctacgggaggctgcagcgacgaatcttccgcaatgcgcgaaagcgtgacggagcaatgccgcgtgcaggatgaagcggctacgccgtgtaaactgctgtcaggtcctcgaaacactgatcaggaccaaaggaagggccggctaaactcgtgccagcagccgcggtaat

SEQ ID NO: 4670 - DNA, 490 bp, Unknown
  Ascusbbf_1290084, encodes 16S rRNA
agagtttgatcctggctcaggacgaacgctggcggcgcgcctaacacatgcaagtcgaacggagcttaagagagcttgcttttttaagcttagtggcgaacgggtgagtaacgcgtgagtaacctgccctggagtgggggacaacagttggaaacgactgctaataccgcataagcccacagcaccgcatggtgcagcgggaaaaggatttattcggtacaggatgggcccgcatctgattagctagttggtgagataacagcccaccaaggcgacgatcagtagccgacctgagagggtgatcggccacattgggactgagacacggcccaaactcctacgggaggcagcagtggggaatattgcacaatgggcgaaagcctgatgcagcgacgccgcgtggaggaagaaggttttcggattgtaaactcctgtcgttagggacgaatcatgacggtacctaacaagaaagcaccggctaactacgtgc

SEQ ID NO: 4671 - DNA, 490 bp, Unknown
  Ascusbbf_893660, encodes 16S rRNA
agagtttgatcctggctcaggacgaacgctggcggcacgcttaaaacatgcaagtcgaacgtgaagcccgggcttgcccgggtggaaagtggcgaacgggtgcgtaacacgtgagcaacctgccccgaagactgggataacaccgggaaaccggtgctaataccggatgccttcaccatgtcgcatggcgaggtgaagaaatggattccgcttcgggatgggctcgcggcctatcagcttgttggtggggtaatggcctaccaaggcaacgacgggtagctggtctgagaggatgtccagccacactgggactgagacacggcccagactcctacgggaggcagcagttaggaatcttgcgcaatgggcgaaagcctgacgcagcgatgccgcgtgcgggatgaaggccttcgggtcgtaaaccgctttcagcagggacgataatgacggtacctgcagaagaagccccggccaactacgtgccagcagc

SEQ ID NO: 4672 - DNA, 254 bp, Unknown
  Ascusbbf_896319, encodes 16S rRNA
agagtttgatcctggctcagattgaacgctggcggcaggcctaacacatgcaagtcgaacggtaacaggaagcagcttgctgcttcgctgacgagtggcgcaagcctgatgcagccatgccgcgtgtatgaagaaggccttcgggttgtaaagtactttcagcggggagggagggagtaaagttaatacctttgctcattgacgttacccgcagaagaagcaccggctaactccgtgccagcagccgcggtaat

SEQ ID NO: 4673 - DNA, 490 bp, Unknown
  Ascusbbf_797536, encodes 16S rRNA
agagtttgatcctggctcaggatgaacgctagcgacaggcttaacacatgcaagtcgaggggcagcggggatgagagcttgctcttatctgccggcgaccggcgcacgggtgagtaacacgtatgcaacctgcccaccgcagggggataagcagaagaaattctgtctaataccgcgtaacatcagagggagacatctctttctgatcaaaggaagcaattccggcggtggatgggcatgcggcgcattagctggttggcggggtaacggcccaccaaggcgacgatgcgtaggggttctgagaggaaggtcccccacactggtactgagacacggaccagactcctacgggaggcagcagtgaggaatattggtcaatgggcgagagcctgaaccagccaagtcgcgtgagggaagacggtcctatggattgtaaacctcttttgtcggggagcaacgaaggcacgtgtgcctgaagtgagattacccg

SEQ ID NO: 4674 - DNA, 490 bp, Unknown
  Ascusbbf_1151435, encodes 16S rRNA
agagtttgatcctggctcaggatgaacgctagcggcaggcttaatacatgcaagtcgaggggcagcaggtctgtagcaatacagatgctggcgaccggcaaacgggtgaggaacacgtacgcaaccttccttcgagtggggaatagcccagggaaacttggattaataccccgtaatattatggagtggcatcactttataattatagcttcggcgcttgaagatgggcgtgcgcctgattaggtagttggcggggtaacggcccaccaagcctgcgatcagtaactggtgtgagagcacgaccagtcacagggcactgagacacgggcccgactcctacgggaggcagcagtaaggaatattgggcaatggacgaaagtctgacccagccatgccgcgtggaggatgaaggtcctctggattgtaaacttcttttatctggaaagaaatccatgttttctaatgtggttgacggtaccagatgaataag

SEQ ID NO: 4675 - DNA, 490 bp, Unknown
  Ascusbbf_541062, encodes 16S rRNA
agagtttgatcatggctcaggatgaacgctggcggcgtgcttaacacatgcaagtcgagcggagatatttaggatgagagcttcggcaggatctttaaatatcttagcggcggacgggtgagtaacgtgtgggcaacctgccctgtactgtggaataatcactggaaacggtgactaataccgcatgtcatcacgaagaggcatctctttgtgagaaaaggatttattcggtacaggatgggcccgcatctgattagctagttggtgagataaaagctcaccaaggcaacgatcagtagccgacctgagagggtgatcggccacattgggactgagacacggcccaaactcctacgggaggcagcagtggggaatattgcacaatgggcgaaagcctgatgcagcaacgccgcgtgaaggaagaagggtttcggctcgtaaacttctatcaatagggacgaaaaaaatgacggtacctaaataagaagcc

SEQ ID NO: 4676 - DNA, 490 bp, Unknown
  Ascusbbf_540191, encodes 16S rRNA
agagtttgatcatggctcaggatgaacgctagcggcaggcctaatacatgcaagtcgaacgggatccagatcaaagcttgctttggtttggtgagagtggcgcacgggtgcgttacgcgtgagcaacctacccatatctgggggatagcccggcgaaagtcggattaataccgcataagattacagaaaggcatcttttagtaattaaagatttatcggatatggatgggctcgcgtgacattagctagttggtaaggtaacggcttaccaaggctacgatgtctaggggctctgagaggagaatcccccacactggtactgagacacggaccagactcctacgggaggcagcagtaaggaatattggtcaatggacgcaagtctgaaccagccatgccgcgtgcaggaagacggccctatgggttgtaaactgcttttgtacgggaacaaacctcggtacgtgtaccgagctgagtgtactgtaagaat

SEQ ID NO: 4677 - DNA, 205 bp, Unknown
  Ascusbbf_1599570, encodes 16S rRNA
agagtttgatcctggctcagcatttgccaccaaatcataagggtctaaaaagagactatctccagctagaatagccgtcgcttcattaaattttttgtggtttgtcaaacgtccacgacgatagtcatcatcatccatagctggtaaatcatcgtgaatcaagcttcctgtgtgaatcatctcaaggccagcagccggcggtaat

SEQ ID NO: 4678 - DNA, 490 bp, Unknown
  Ascusbbf_1640889, encodes 16S rRNA
agagtttgatcatggctcaggacaaacgctggcagcatacttcatacatgcaagtcgaacgagaaactgacttcggtcagtggaaagtggcaaacaggtaagtaatatataaagaatctgccctaaaaagagggacaacagttgaaaacagctgctaatacctcatatgcgcgtacttggaatagtattcgtgaaaactccggtgctctgggatgagtctgcatctgattagctagttggcggtgtaatggaccaccaaggcgacgatcagtagctggtttgagaggatgatcagccacaatgggactgagacacggcccatactcctacaggaggcagcagtagggaattttgcgcaataggggaaaccctaacgcagcaacgccgcgtgattgaataagcccttcgggatataaagatctatcaataggaacgaaacttgacggtacctacagaggaagcatcggctaactccgtgccagcagccgcg

SEQ ID NO: 4679 - DNA, 486 bp, Unknown
  Ascusbbf_512190, encodes 16S rRNA
agagtttgatcctggctcagaacgaacgctggcggcaggcttaacacatgcaagttgaacgggaggtaatggtgcttgcactattaccgagagtggcgcacgggtgagtaatacatgggaacataccctgaagtgggggacaacagttggaaacgactgctaataccgcataatccctgcgggggaaagatttatcgctttaggaatggcccatggcagattaggtagttggtggggtaaaggcttaccaagccgacgatctgtagctggtctgagaggacgatcagccacactggaactgagacacggtccagactcctacgggaggcagcagtgaggaatattgggcaatggagggaactctgacccagccatgccgcgtgagtgaagaaggttttcgaattgtaaagctctttcggatgtgaagatgatgacggtagcatctaaagaagccccggcaaacttcgtgccagcagccgcggtaat

SEQ ID NO: 4680 - DNA, 184 bp, Unknown
  Ascusbbf_606491, encodes 16S rRNA
agagtttgatcctggctcagcatcgtcccgggtttaatctcgtcctcctcatcttgccagcagccgcggtaatagagtttgatcatggctcagccagcagccgcggtaatagagtttgatcatggctcagccagcagccgcggtaatagagtttgatcatggctcagccagcagccgcggtaat

SEQ ID NO: 4681 - DNA, 490 bp, Unknown
  Ascusbbf_1692775, encodes 16S rRNA
agagtttgatcatggctcaggatgaacgctggcggcgtgcctaatacatgcaagtcgaacgctctagtagcaatactagggagtggcgaacgggtgagtaacacgtagataacctgccctaacttcgaggataacttcgggaaactggagctaatactggataggatgtcttgaggaatcttgggacatttaaagatttatcgagttaggaggggtctgcggcgcattagttagttggtggggtaacggcctaccaagacaatgatgcgtagccggactgagaggtctaacggccacattgggactgagaacggcccaaactcctacgggaggcagcagtagggaattttcggcaatgggggaaaccttgaccgagcaacgccgcgtgaacgaagaagttcttcggaatgtaaagttcttttatctgggaagaaaaataaccaaattgacggtaccagatgaataagccccggctaactatgtgccagca

SEQ ID NO: 4682 - DNA, 490 bp, Unknown
  Ascusbbf_1509621, encodes 16S rRNA
agagtttgatcctggctcaggatgaacgctggcggcgtgcttaacacatgcaagtcgaacggagacaacccaccgagtgaagccttagcttgctttggccgacctcaccgggttatcttagtggcggacgggtgagtaacgcgtggataacctgcctgtatctgggggataacagttagaaatgactgctaataccgcataagcgcacggcaccgcatggtactgtgtgaaaaactccggtggatacagatggatccgcgttagattagccagttggcggggtaacggcccaccaaagcgacgatctatagccggcctgagagggcgaccggccacattgggactgagacacggcccaaactcctacgggaggcagcagtggggaatattgcacaatgggggaaaccctgatgcagcgacgccgcgtgagtgaagaagtatttcggtatataaagctctatcagcagggaagaaattgacggtacctgac

SEQ ID NO: 4683 - DNA, 490 bp, Unknown
  Ascusbbf_569549, encodes 16S rRNA
agagtttgatcatggctcaggatgaacgctggcggcgtgcctaatacatgcaagtcgaacgagatgtagcaatacatcgagtggcgaacgggtgagtaacacgtattcaatctgccctaacgactgggataccctcgggaaaccttggctaataccggataggagctttgatcgcatgattgaagctttaaaggatcttttgattcacgataggatgagaatgcggcgcattagttagttggtgagataaaagcccaccaaggcaacgatgcgtagccgacctgagagggtgatcagccacactgggactgagacacggcccagactcctacgggagacagcagttaggaatattcgtcaatgggggaaaccctgaacgagcaatgccgcgtgaaggatgaaggtcctatggattgtaaacttctgttgttagggaagaacgactgatataggaaatgatatcagtgtgacggtacctttccagaaagct

SEQ ID NO: 4684 - DNA, 490 bp, Unknown
  Ascusbbf_1610187, encodes 16S rRNA
agagttgatcctggctcaggatgaacgctggcggcgtgcctaatacatgcaagtcgagcgaatctttaggagcttgctcctaaaggttagcggcggacgggtgagtaacacgtgggcaacctacctgtaagactgggataacttcgggaaaccggagctaataccggataatatgtaagacctcatggtcttacattgaaagatggcctcggctatcacttacagatgggcccgcggcgcattagctagttggtgaggtaacggctcaccaaggcaacgatgcgtagccgacctgagagggtgatcggccacactgggactgagacacggcccagactcctacgggaggcagcagtagggaatcttccgcaatggacgaaagtctgacggagcaacgccgcgtgagcgatgaaggccttcgggtcgtaaagctctgttgttagggaagaacaagtatcattcgaatagggcggtaccttgacggtaccta

SEQ ID NO: 4685 - DNA, 486 bp, Unknown
  Ascusbbf_1431455, encodes 16S rRNA
agagtttgatcctggctcagaacgaacgctggcggcacgcttaacacatgcaagtcggacaggatgaagttagtttactaatggaatttagtggcggactggtgagtataatacaagaatatgcccttaggtaggggatagctttgggaaactggaggtaataccgtataaggtcgagagagaaaagcagagatgcgcctgaggattagcctgtatctgattaggaagttggtagggtaaaggcctaccaatccgaggatcagtagctgttctgagaggaagatcagccacattgggactgagatacagcccagactcctacgagaggcagcagtgaggaatattggacaataggaaaaaccctgatccagcaatgccgcgtgaatgaagaaggttttcggattgtaaagttcttttcttagggaagatgatgacagtacctgaggaataagcaccggcaaactctgtgccagcagccgcggtaat

SEQ ID NO: 4686 - DNA, 490 bp, Unknown
  Ascusbbf_479080, encodes 16S rRNA
agagtttgatcctggctcaggagaaacgctggcggcgcacataagacatgcaagtcgaacggaacttagtcgaatgtttacatgagacgaaagtttagtggcggacgggtgagtaacacgtgagcaacctgcctttaagagggggataacattgagaaatcagtgctaataccgcataacgcatttctaccgcatgatagaaatagccaaaggagaaatccgcttagagatgggctcgcggctgattagttagttggtggggtaatggcctaccaagacgatgatcagtagccgagctgagaggcacaacggccacattgggactgagacacggcccagactcctacgggaggcagcagtcgggaatattgcacaatgggggaaaccctgatgcagtgacgccgcgtataggaagaaggtctttggattgtaaagctctgttataggggacgaaggaagtgacggtaccctataaggaagccccggctaa

SEQ ID NO: 4687 - DNA, 490 bp, Unknown
  Ascusbbf_993166, encodes 16S rRNA
agagtttgatcctggctcaggacgaacgctggcggcgtgcttaacacatgcaagtcgagcggtaaggctccttcgggagtacacgagcggcgaacgggtgagtaacacgtgagtaatctgcccttcacttcgggataaccaccggaaacggtggctaataccgaatacgaccagtcttcgcatgaggtgctggtggaaagtcttttcggtggaggatgtgctcgcggcctatcagcttgttggtggggtaatggcctaccaaggcttcgacgggtagccggcctgagagggtgaccggccacactgggactgagacacggcccagactcctacgggaggcagcagtggggaatattggacaatgggcgaaagcctgatccagcaacgccgcgtgagggatgacggccttcgggttgtaaacctctttcagtatcgacgaagcgccctgtcgggtggtgacggtagatacagaagaaggaccggccaacta

SEQ ID NO: 4688 - DNA, 489 bp, Unknown
  Ascusbbf_1695214, encodes 16S rRNA
agagtttgatcctggctcaggatgaacgctggcggcgtgtctaaggcatgcaagtcgtatgcctgtagcaatacaggcatggcaaacgggagagtaacacattggcaacttaccccaaagacgaggataaccttgcgaaagcgaggataatactcgatggtattatccgccccagggcggataattaaagctccggcgctttgggagaggcctatggcctatcagctagttggtgaggtaacggctcaccaaggctatgacgggtatggggtgcgagagcatggccccactcactgggactgagacactgcccagactcctacgggaggctgcagtcaagaatcttcctcaatgggcgaaagcctgaaggagcgacgccgcgtgtatgaagaagcccttcggggtgtaaagtacttttatctgggacgaaacaatgacggtaccagatgaataaggggctgctaacctcgtgccagcagccgcggtaat

SEQ ID NO: 4689 - DNA, 490 bp, Unknown
  Ascusbbf_1788453, encodes 16S rRNA
agagtttgatcctggctcaggacgaacgctggcggcgtgcctaatacatgcaagtcgagcgagtcccttcgggggctagcggcggacgggtgagtaacacgtaggcaacctgcctgtaagactgggataacatagggaaacttatgctaataccggatagggttttggatcgcatgatccgaaacggaaagatggcgcaagctattacttacagatgggcctgcggcgcattagctagttggtggggtaacagcctaccaaggcgacgatgcgtagccgacctgagagggtgaccggccacactgggactgagacacggcccagactcctacgggaggcagcagtagggaattttccacaatggacgaaagtctgatggagcaacgccgcgtgaacgatgaaggctctcgggtcgtaaagttctgttgttagggacgaacaagtgccgttcgaacagggcggcaccttgacggtacctaacgagaaagcc

SEQ ID NO: 4690 - DNA, 488 bp, Unknown
  Ascusbbf_1832455, encodes 16S rRNA
agagtttgatcctggctcagaacgaacgctggcggcaggcttaacacatgcaagtcgagcgccccgcaaggggagcggcagacgggtgagtgacacgtgggaatctacccatcactacggaacaactccgggaaactggaactaataccgtatacgtccttcgggagaaagatttatcggtgatggatgagcccgcgttggattagctagttggtaaggtaacggcttaccaaggcgacgatgtctaggggagctgagaggcttatcccccacactggtactgagacacggaccagactcctacgggaggcagcagtgaggaatattggtcaatggacggaagtctgaaccagccatgccgcgtggaggaagaaggtcctatgggttgtaaactccttttgttccggagtaataaggtctatgcgtagaccgatgagagtacgggacgaataagcatcggctaactccgtgccagcagccgcggtaat

SEQ ID NO: 4691 - DNA, 490 bp, Unknown
  Ascusbbf_1122394, encodes 16S rRNA
agagtttgatcctggctcagattgaacgctggcgacaggcttaacacatgcaagtcgaacggagaacctctgaacgagttttcggacaagtgatgagaattcttagtggcggacgggtgagtaacgcgtgaggaacctgccttggagaggggaataacacagagaaatttgtgctaataccgcataatgcagttgggtcgcatggctctgactgccaaagatttatcgctctgagatggcctcgcgtctgattagcttgttggcggggtaacggctcaccaaggcgacgatcagtagccggactgagaggctggccggccacattgggactgagacacggcccagactcctacgggaggcagcagtggggaatattgggcaatgggcgcaagcctgacccagcaacgccgcgtgaaggaagaaggctttcgggttgtaaacttcttttatgagggacgaagaaagtgacggtacctacagaagaagcacc

SEQ ID NO: 4692 - DNA, 490 bp, Unknown
  Ascusbbf_797700, encodes 16S rRNA
agagtttgatcctggctcagaacgaacgctggcggcgtggattaggcatgcaagtcgagcgagaatctgggagttcaagttttcggacgaggacttccggaggaaagcggcggaagggtgagtacaacatggacaatccatctccaagatgggcatagcctcccgaaaggggggataatgccgaatgtggcgagccggggcatcccggcggagctaaaggcggggaccgcaaggcctgccgcttggagccgggtccgtgcgctatcagcttgttggcggggtaacggcccaccaaggcgatgacggctagctggtctgagaggatggtcagccacactgggactgagatactgcccagactcctacgggaggctgcagtcgagaatcattcgcaatgggcggaagcctgacggtgcgacgtcgcgtggaggacggaggtcttcggattgtaaactccttttgtgagggataaacgtgtgcgaggcgaaca

SEQ ID NO: 4693 - DNA, 490 bp, Unknown
  Ascusbbf_682419, encodes 16S rRNA
agagtttgatcatggctcaggatgaacgctagctacaggcttaacacatgcaagtcgaggggcagcatgaacttagcttgctaagtttgatggcgaccggcgcactggtgagtaacacgtatgcaacctgcctcctccagggggataacccagagaaatttggcctaataccccatagtccgcgagagggcatcctcttgcggggaaagccccggcgggaggagatgggcatgcggcgcattagcttgttggcggggcgacggcccaccaaggctacgatgcgtaggggttctgagaggaaggtcccccacactggtactgagacacggaccagactcctacgggaggcagcagtgaggaatattggtcaatgggcgaaagcctgaaccagccaagtagcgtgcaggacgacggccctatgggttgtaaactgcttttataggggaataaagttatccacgtgtggatatttgcatgtaccctatgaata

SEQ ID NO: 4694 - DNA, 488 bp, Unknown
  Ascusbbf_1287959, encodes 16S rRNA
agagtttgatcctggctcagaacgaacgctggcggcaggcctaacacatgcaagttgaacgggatttaatctgtgcttgcacagattaatgagagtagcgcacgggtgagtaacacgtgggaacataccatgaagtgggggacaacagttggaaacgactgctaataccgcataatccctgagggggaaagatttatcgctttatgaatggcccgcggaagattaggtagttggtgaggtaatggcccaccaagcctacgatctatagctggtttgagaggatgatcagccacactggaactgagacacggtccagactcctacgggaggcagcagtgaggaatattgggcaatggggggaaccctgacccagccatgccgcgtgagtgaagaaggttttcggattgtaaagctctttcggatgtgacgatgatgacggtagcatctaaagaagccccggcaaacttcgtgccagcagccgcggtaat

SEQ ID NO: 4695 - DNA, 490 bp, Unknown
  Ascusbbf_695330, encodes 16S rRNA
agagtttgatcctggctcaggatgaacgctggcggcgtgcctaacacatgcaagtcgaacgtgaagggtttttggactagcaataggccaaaggcttggaaagtggcgaacgggtgagtaacacgtggataacctgccgcgcagagggggataacgactggaaacggtcgctaataccgcatggtaccgagggatggggacattctttggttaaaactctggtgctgcgtgaggggtctgcgaccgattagctagttggtggggtaatggcctaccaaggcgatgatcggtagctagtctgagaggatgattagccacacgggaactgagacacggtcccgactcctacggggggcagcagtgaggaatattgcacaatggacgcaagtctgatgcagcaacgccgcgtggaggatgacggcccttgggttgtaaactccttttttcagggaagagaatggacggtacctgaagaataagtcacggctaa

SEQ ID NO: 4696 - DNA, 490 bp, Unknown
  Ascusbbf_1434728, encodes 16S rRNA
agagtttgatcatggctcaggatgaacgctggcggcaggcttaacacatgcaagtcgaggggtaacgcggggtagcaatactctggcgacgaccgtcgcacgggtgcgtaacgcgtatgcaacctacctgtaccaggggtataacggagagaaatttccactcatcccccatatttttattctttcgcatgttaggataatgaaagcttcggtggttacgtatgggcatgcgttacattagctagttggtaaggtaacggcttaccaaggcgacgatgtctaggggagctgacaggcttatcccccaaactggtactgcgacacggaccagatgcctacgggaggcagcagtgaggaatattggtcaatggacggaagtctgaaccagccatgcagcgtggaggaagaaggtcctatgggttgtaaactccttttgttcgagagtaataagggctttgcgaagcccgatgagagtatcggacgaataagc

SEQ ID NO: 4697 - DNA, 488 bp, Unknown
  Ascusbbf_1372860, encodes 16S rRNA
agagtttgatcctggctcagaacgaacgctggcggcaggcttaacacatgcaagttgagcgggattaattgatagcatgctattaattatgagagcagcgcactggtgagtaacacgtgggaacataccttttggtgggggacaacagttggaaacgactgctaataccgcataagccctaagggggaaagattaatggccgaacgattggcccgcggaagattaggtagtaggtggggtaacggcctacctagccgacgatctatagctggtctgagaggacgatcagccacattggaactgcgacacggaccagtgtcgtacagggggcagcagtgaggagtattaggcaatggaggcaactctggcccagccatgccgcgtgattgaagaaggttttcggatggtaaagctctttcggacgggaagatgatgacggtaccgtcagaagaagcaccggctaacttcgtgccagcagccgcggtaat

SEQ ID NO: 4698 - DNA, 490 bp, Unknown
  Ascusbbf_810979, encodes 16S rRNA
agagtttgatcctggctcaggatcaacgctggcggcgtgcctaatgcatgcaagtcgagcggggtgatcttcggatcacttacgcggcggacgggtgcggaacacgtgggcaacctgccctgaggtgggggatagccggtggaaacaccgggtaattccgcatacggtcaacttccggagggaggttgaggaaagggtcttcggactcgccttgggaggggcctgcggccgattagctagacggtggggtaacggcctaccgtggcgatgatcggtagctggtctgagaggacggccagccacacggggactgagacacggaccaaactcctacgggaggcagcagtgaggaatattggtcaatgggcgaaagcctgaaccagccaagtagcgtgcaggacgacggccctatgggttgtaaactgcttttataggggaataaagttatccacgtatggatatttgcatgtaccctatgaataaggaccgg

SEQ ID NO: 4699 - DNA, 490 bp, Unknown
  Ascusbbf_1579471, encodes 16S rRNA
agagtttgatcatggctcagaacgaacgctggcggcaggcttaacacatgcaagttgaacgggaacgataagatagcttgctattttattgcgagagtagcgcactggtgagtaacacgtgggaacatacctataggtgggggacaacagttggaaacgactgctaataccgcatacgccctaagggggaaagatttattgccgatagattggcccgcggaagattaggtagttggtggggtaacggcctaccaagccgacgatctatagctggtctgagaggacgatcagccacattggaactgagacacggtccagactcctacgggaggcagcagtgaggaatattgggcaatggaggaaactctgacccagccatgccgcgagagtgatgaaggttttcggattgtaaagctctttcggatgtgaagatgatgacggtagcatctaaagaagccccggcaaacttcgtgccagcagccgcggtaat

SEQ ID NO: 4700 - DNA, 490 bp, Unknown
  Ascusbbf_1020429, encodes 16S rRNA
agagtttgatcctggctcaggatgaacgctggcggcgtgcctaacacatgcaagtcgaacgttagggtttagcaataaacccaaaagtggcgaacgggtgagtaacacgtggataacctgccgcgcagagggggataacgactggaaacggtcgctaataccgcatggtactaagaagtatggacgcttcttggttaaaactttggtgctgcgcgaggggtctgcgtccgattagctagttggtgaggtaatggctcaccaaggctgtgatcggtagctagtctgagaggatgattagccacacgggaactgagacacggtcccgactcctacggggggcagcagtgaggaatattgcacaatggacgcaagtctgatgcagcaacgccgcgtggaggatgacggtctttggattgtaaactccttttctcagggaagagaatggacggtacctgaggaataagtcacggctaactacgtgccagcagcc

SEQ ID NO: 4701 - DNA, 486 bp, Unknown
  Ascusbbf_1020652, encodes 16S rRNA
agagtttgatcctggctcagaatcaatgctggcggcgcgcttaacacatgcaagtcgaacgagaaagttcccttcgggggatgagtacagtggcgtacgggtgagtaacacgtggattatctaccttctggtggggaataaccctgggaaaccggggctaataccgcataacctcgcaagagaaaagcagcaatgcgccggaagaggagttcgcggctgattagctagatggtgaggtaatggctcaccatggcgaagatcggtagccggcctgagagggcacacggccacactggcactgaaacacgggccagactcctacgggaggcagcagtggggaatcttgcacaatgggggaaaccctgatgcagcgacgccgcgtgagcgatgaagcctttcggggtgtaaagctctttcgacgggaacgattatgacggtacccgaagaagaagctgcggctaactacgtgccagcagccgcggtaat

SEQ ID NO: 4702 - DNA, 183 bp, Unknown
  Ascusbbf_380201, encodes 16S rRNA
agagtttgatcctggctcagcggttaacgtacccagctagcatccacgaggacatgggtttgatccctggcctcgctcagtgggttaaggatctggcatttccatgagctgtggtgtaggttgcagacatggctcaggtcccatgttgctgtggctttggtgtaggccagcagccgcggtaat

SEQ ID NO: 4703 - DNA, 490 bp, Unknown
  Ascusbbf_882471, encodes 16S rRNA
agagtttgatcctggctcagcctgaacgctggcggcgtggctaagacatgcaagtcgaacgaaacagtggcgaacgggtgagtaatgtgtcgctaacctgcctctggctcgaggatagcggagggaaacttccggtaatactcgatgtgtctccgttgtcgcatggcgacggatacaaagctttatgcggcctgggatggggcgacatggtatcagctagttggtgaggtaaaggctcaccaaggcttcgacgcctaaccggactgagaggtcggccggtcacatcgggactgagacactgcccggactcctacgggaggctgcagtaacgaatcttccgcaatgcacgaaagtgtgacggagcgacgccgcgtgcgggacgaagcccttcggggtgtaaaccgcttttacggggggataaagtgagtgacgtgtcattcattgcaggtaccccgcgaataaggaccggctaattccgtgccagcagccg

SEQ ID NO: 4704 - DNA, 490 bp, Unknown
  Ascusbbf_502671, encodes 16S rRNA
agagtttgatcatggctcagaacgaacgctggcggcatgcctaacacatgcaagtcgaacgagaccttcgggtctagtggcgcacgggtgcgtaacgcgtgggaacctgcccttaggttcggaataactcctcgaaaggggtgctaataccggataatgtcttcggaccaaagatttatcgcctttggatgggcccgcgttggattagctagttggtgaggtaaaggctcaccaaggcgacgatccatagctggtcttagaggatgatcagccacactggaactgagacacggtccagactcctacgggaggcagcagtggggaatattggacaatggacgaaagcctgatccagccatgccgcgtgagtgaagaaggccttcgggttgtaaagctcttttgttgggaaagaaaagcaatcggttaatacccggttgttctgacggtacccaaagaataagcaccggctaacttcgtgccagcagccgcg

SEQ ID NO: 4705 - DNA, 490 bp, Unknown
  Ascusbbf_466811, encodes 16S rRNA
agagtttgatcatggctcaggatgaacgctggcggcatgcctaatacatgcaagtcgaacggaagcagcaatgctttagtggcgaacgggtgagtaatatatagacaacctacctttaagacgaggatagcagttggaaacgattggtaatactggataggatacaagttcacatgaactaatatttaaaggggcaactgccccgcttgatgaggggtctatatcgcattagctagttggtagggtaacggcctaccaaggcgatgatgcgtagctgtgctgagaggcaaaacagccacattgggactgagacacggcccaaactcctacgggaggcagcagtagggaattttcggcaatgggggcaaccctgaccgagcaatgccgcgtgaatgatgaaggtcttcggatcgtaaagttctgttatcaggaaagaacgacatagagagtggaaagctctatgcatgacggtacctgattagaaagcccc

SEQ ID NO: 4706 - DNA, 490 bp, Unknown
  Ascusbbf_1782915, encodes 16S rRNA
agagtttgatcatggctcaggatgaacgctggcggcgtgcctaacacatgcaagtcgaacgaagcatttcagatgaagttttcggatggattctgagatgactgagtggcggacgggtgagtaacacgtggataacctgcctcacactgggggacaacagttagaaatgactgctaataccgcataagcgcacagtgccgcatggtacagtgtgaaaaactccggtggtgtgagatggatccgcgtctgattagccagttggcggggtaacggcccaccaaagcgacgatcagtagccgacctgagagggtgaccggccacattgggactgagacacggcccagactcctacgggaggcagcagtgggggatattgcacaatggaggaaactctgatgcagcgacgccgcgtgggtgaagaagtatttcggtatgtaaagctctgttgcaagggaagaacggcacatagaggatatgtgagtgacggtac

SEQ ID NO: 4707 - DNA, 490 bp, Unknown
  Ascusbbf_1109801, encodes 16S rRNA
agagtttgatcatggctcagaacgaacgctggcggcgtgcctaacacatgcaagtcgagcgcgaatggagcaatcctagtagagcggcgcacgggtgcgtaacacgtgggtaatctgcccaaaagtccgggataacctgccgaaaggctggctaataccgggtaagcctacggggtcttcggatcctgaaggaaaaggtggcctctgtatacaagctatcgcttttggatgagcccgcggcccatcagctagttggcggggtaatggcccaccaaggcaacgacgggtagctggtctgagaggacgatcagccacactgggactgagacacggcccagactcctacgggaggcagcagtggggaatattgcacaatgggcggaagcctgatgcagcgacgccgcgtgggggatgacggtcttcggattgtaaacccctttcagtagggacgaagcgcaagtgacggtacctgcagaagaagcaccggcta

SEQ ID NO: 4708 - DNA, 490 bp, Unknown
  Ascusbbf_877847, encodes 16S rRNA
agagtttgatcatggctcaggatgaacgctggcggcgtgcttaacacatgcaagtcgaacggagatactatgtgagcggagatagcttgctattaacaatcttttagtatcttagtggcggacgggtgagtaacgcgtggataacctgccttgtactgggggataacacttagaaataggtgctaattccgcataagcgcacaggaccgcatggtctggtgtgaaaaactccggtggtacaagatggatccgcgtctgattagctagttggtaaggtaacggcctaccaaggcaacgatcagtagccggcttgagagagggaacggccacattgggactgagacacggcccaaactcctacgggaggcagcagtggggaatattgcacaatgggcgaaagcctgatgcagcgacgccgcgtgagtgaagaagtatttcggtacgtaaagctctatcagcaaggaagaaaatgacggtacttgactaagaa

SEQ ID NO: 4709 - DNA, 329 bp, Unknown
  Ascusbbf_966499, encodes 16S rRNA
agagtttgatcctggctcaggatgaacgccggcggtgcattagctagttggtaaggtaacggcttaccaaggcgatgatgcatagccgagttgagagactgatcggccacaatggaactgagacacggtccatactcctacgggaggcagcagtagggaatcttccacaatgggcgcaagcctgatggagcaacaccgcgtgagtgaagaagggtttcggctcgtaaagctctgttgttggagaagaacgtgcgtgagagtaactgttcacgcagtgacggtatccaaccagaaagtcacggctaactacgtgccagcagccgcgtaat

SEQ ID NO: 4710 - DNA, 490 bp, Unknown
  Ascusbbf_1612781, encodes 16S rRNA
agagtttgatcctggctcaggatgaacgctggcggcgtgcctaacacatgcaagtcgaacgagtgaggtatgaaacctagtgattaccgagcgagtggcggacgggtgagtaacgcgtgggtaacctgccttacagagggggataacagtttgaaaagactgctaataccgcataagcacacagtaccgcatggtacagggtgaaaagatttatcactgtaagatggacccgcgtctgattaggtagtaggcggggcaacggcccacctagccgacgatcagtaggggttctgagaggaaggtcccccacattggaactgagacacggtacaaactcctacgggaggcagcagtgaggaatattggtcaatgggcgggagcctgaaccagccaagtagcgtgcaggatgacggccctatgggttgtaaactgcttttatcaggggataaagtgacccacgtgtggatatttgcatgtaccctatgaataa

SEQ ID NO: 4711 - DNA, 490 bp, Unknown
  Ascusbbf_636341, encodes 16S rRNA
agagtttgatcctggctcaggacgaacgctggcggcgtgcctaacacatgcaagtcgaacggggtacttaggagcaaggcttcggccgagcgaataagttacctagtggcggacgggtgagtaacgcgtgagcaacctaccttcaagagggggataacgactggaaacggtcgctaataccgcataaaatccagtggaagcatttttattggatcaaaggagcaatccgcttgaagatgggctcgcgtctgattagctagtaggtgaggtaatggctcacctaggcgacgatcagtagccgaactgagaggttgatcggccacattgggactgagatacggcccagactcctacgggaagcagcagtgggggatattgcgcaatgggggaaaccctgacgcagcaacgccgcgtgaaggaagaaggccttcgggttgtaaacttctgtcttatgggaagaaacaaatgacggtaccataggaggaagctc

SEQ ID NO: 4712 - DNA, 490 bp, Unknown
  Ascusbbf_1372252, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagaggaatttccactaatcccccatattgttattctttcgcatgttaggataacgaaagcttcggtggttacgtattggcatgcgtgacagtagctagttggtaaggtaacgacttaccaaggcgacgatgtctaggggagctgagaggcttatccccgacactggtactgagaaacgggcaggactcctccgggaggcagcagtcgggaatattgcgaaatggaggaaactctgacgcagtgacgccgcgtgcaggaagaaggtgttcggattgtaaactgctttagacagggaagaaaaaagacagtacctgtagaataagctccggctaactacgtgcca

SEQ ID NO: 4713 - DNA, 490 bp, Unknown
  Ascusbbf_537332, encodes 16S rRNA
agagtttgatcctggctcaggacgaacgctggcggcgtgcttaacacatgcaagtcgagcggggacaaacggggtgcttgcaccctgattgttctggcggcggacgggtgagtaacgcgtgagcaatctgtcccagacagggggataacacttggaaacaggtgctaataccgcataagaccacgaggtcgcatggccttgaggtaaaaggaggaatccggtttggggtgagctcgcgtctgattagctagttggtggggtaaaggctcaccaaggcaacgatcagtagccgacctgagagggtgatcggccacactgggactgagacacggcccagactcctacgggaggcagcagtggggaatattggacaatggggggaaccctgatccagcaacgccgcgtgagggaagaaggttctcggattgtaaacctctgtcctcagggaagaaaaaaatgacggtacctgaggaggaagccccggctaact

SEQ ID NO: 4714 - DNA, 490 bp, Unknown
  Ascusbbf_1680394, encodes 16S rRNA
agagtttgatcatggctcaggacgaacgctggcggcgtgcttcatacatgcaagtcgaacgagaagctgacttcggtcagtggaaagtggcggacgggtgagtaatatgtaggaaatctgccctagagagggggacaacagagggaaacttctgctaataccccatatgagcttagttgaaatactaatcttgaaaactccggtgctctgggatgagcctgcatctgattagctagttggtggtgtaatggaccaccaaggcgacgatcagtagctggtttgagaggatgatcagccacaatgggactgagacacggcccatactcctacgggaggcagcagtagggaattttgcgcaatgggcgaaaggctgaagcagcaacgccgcgtggaggatgaaggcatatttgttgtaaactcctgtaagtggggaaaaattggtctgtttacagactttgattgtacccacagagtaagccccggctaacta

SEQ ID NO: 4715 - DNA, 490 bp, Unknown
  Ascusbbf_827153, encodes 16S rRNA
agagtttgacatggctcaggacgaacgctggcggcgtgcctaaaacatgcaagtcgaacggagcaccccggacagagacttcggtcaatagaagggaatgcttagtggcggacgggtgagtaacgcgtgagcaacctgcctcaaagagggggacaacagttggaaacgactgctaataccgcataaagcaagagtaccgcatggtgcatttgccaaagatttatcgctttgagatgggctcgcgtctgattagatagttggtggggtaacggcccaccaagtcgacgatcagtagccggactgagaggttgtacggccacattgggactgagatacggcccagactcctacgggaggcagcagttgggaatattgcgcaatggggggaaccctgacgcagcaacgccgcgtgaaggaagacggttttcggattgtaaacttcttttattgaggacgaaacaaatgacggtactcaatgaataagctccgg

SEQ ID NO: 4716 - DNA, 490 bp, Unknown
  Ascusbbf_1288193, encodes 16S rRNA
agagtttgatcctggctcaggatgaacgctagcggcaggcctaatacatgcaagtcgaacggcagcgggtccagcaatggatgccggcgagtggcgcacgggtgcgtaacacgtatgcaatctacctgtaacttagggatagcccggagaaattcggattaatacctaatgataaccgagactggcatcagtttttgtttaaagatttatcggttacagatgagcatgcgtctgattagttagttggtgaggtaacggctcaccaagacgatgatcagtaggggacctgagagggcgatcccccacactggtactgagatacggacctgactcctacgggaggcagcagtagggaatattgggcaatggtcgagagactgacccagccatgccgcgtgcaggatgaaggccttatgggttgtaaactgcttttgatcgggaacaaagaggccatgcgtggcaagatgagtgtaccgatagaataagcacc

SEQ ID NO: 4717 - DNA, 490 bp, Unknown
  Ascusbbf_1498158, encodes 16S rRNA
agagtttgatcctggctcagaacgaacgctggcggcatggattaggcatgcaagtcgaacgaggcagcaatgccgagtggcggaagggtgaggaacgcgtgagcaatctgccctccagttgggaataacagttggaaacgactgctaataccgaatgtggctcatcggtcgcatgactgacgggctaaagatttatcgctggaggatgagctcgcgtcccattagctagttggtgaggtaacggcccaccgagccatcgatcagtaggggttctgagaggaaggtcccccacattggtactgagacacggaccaaactcctacgggaggcagcagtgaggaatattggtcaatgggcgagagcctgaaccagccaagtagcgtgcaggatgactgccctatgggttgtaaactgcttttataggggaataaagtgaggtacgtgtacctttttgtatgtaccctatgaataaggaccggctaattccgtg

SEQ ID NO: 4718 - DNA, 490 bp, Unknown
  Ascusbbf_453735, encodes 16S rRNA
agagtttgatcatggctcaggatgaacgctggcggcgtgcctaacacatgcaagtcgagcggaattaataatgcttgcactaataatttagcggcggacgggtgagtaacacgtggataacctgccctatacaggaggataacaatgagaaatcattgctaatactgcataagcttactgatacgcatgtaagagtaagaaaaagtgtaaactggtataggaggggtccgcgtctgattagctagttggagaggtaaaggctcaccaaggcgacgatcagtagccggcctgagagggtggacggccacattgggactgagacacggcccaaactcctacgggaggcagcagtggggaatattgcacaatggggggaaccctgatgcagcaacgccgcgtgaaggaagaaggttttcggatcgtaaacttctatcgacggggaagaaaataatgacggtacccgagtaagaagccccggctaactacgtgc

SEQ ID NO: 4719 - DNA, 490 bp, Unknown
  Ascusbbf_1901888, encodes 16S rRNA
agagtttgatcatggctcagattgaacgctggcggcatgcttaacacatgcaagtcgaacggtagcatattctagcttgctagaagggtgacgagtggcgaacgggtgagtaacgcgtaggaatgtgccttaaagagggggataacctggggaaactcaggctaataccgcataatctctgtggagaaaagctagggaccttcgggcctggtgctttaagaacagcctgcgtccgattagctagttggtggggtaaaggcctaccaaggcgacgatcggtagctggtctgagaggatgatcagccacactggaactgagacacggtccagactcctacgggaggcagcagtggggaatattggacaatgggggcaaccctgatccagcaatgccgcgtgtgtgaagaaggcctgagggttgtaaagcactttcagtggggaggaggattgctaggttaagagctaagtaattggacgttacccacagaag

SEQ ID NO: 4720 - DNA, 490 bp, Unknown
  Ascusbbf_453001, encodes 16S rRNA
agagtttgatcctggctcaggacgaacgctggcggcgtgcttaacacatgcaagtcatggggacccagcaatgggtaaccggcgaacgggtgcgtaacacgtgagtgacctgccgatttgtgggggatagccgggccaacgcccgggtaataccgcatacgctcttcttggggcatctctagaagaggaaacctccggggcaaatcgagggactcgcggcctatcagctagttggcgaggtaacggctcaccaaggctacgacgggtagctggtctgagaggatggccagccacattgggactgagatacggcccagactcctacgggaggcagcagtggggaatattgcgcaatggcctaacggctgacgcagcgacgccgcgtgtgggatgacgcccttcggggtgtaaaccactgttgctcgagacgaatagcgagctttagctcgcctgacggtatcgagtgaggaagcaccggctaactccgtgc

SEQ ID NO: 4721 - DNA, 490 bp, Unknown
  Ascusbbf_1178040, encodes 16S rRNA
agagtttgatcatggctcaggatgaacgctagctacaggcttaacacatgcaagtcgaggggtaacgatattgaaagcttgctttcgataggcgacaaccggcgcacgggtgagtaacgcgtatccaacctgcccataactaagggataatccgtagaaatgcggtctaataccttatgtgttccgacgaggacatctgaattggaataaagattgatcgcctcgggatggggatgcgtaggattaggcaggcggcggggtaacggcccaccgcgccgacgatccttaggggttctgagaggagggtcccccacactggtactgagacacggaccagactcctacgggaggcagcagtgaggaatattggtcaatgggcgagagcctgaaccagccaagtagcgtgcaggatgacggccctatgggttgtaaactgcttttgtacggggataaagtgagtcacgtgtggcttattgcaggtaccgtacgt

SEQ ID NO: 4722 - DNA, 490 bp, Unknown
  Ascusbbf_803983, encodes 16S rRNA
agagtttgatcctggctcaggattaacgctggcggcatgcctaatacatgcaagtcgaatgcctgtagcaatacagaaacatggcgaacgggtgagtaatacataagtaacctaccctgatgatggggataacacctagaaatgggtgctaataccgaataatccagtttgtaaagaattacagatagggaaaggatcgcaagatcgcattaggatgggcttgtgacgcattagctagttggtggggtaaaggcctaccaaggcaacgatgcgtagccgacctgagagggtgaacggccacactggaactgagacacggtccagactcttacgggaggcagcagtagggaattttcggcaatgggcgaaagcctgaccgagcaatgccgcgtgaacgaagaaggtcttcggattgtaaagttcttttacaagggaagaaaaggctcaatggacttgagcaattgacggtaccttgagaataagccacggc

SEQ ID NO: 4723 - DNA, 490 bp, Unknown
  Ascusbbf_1547377, encodes 16S rRNA
agagtttgatcatggctcaggatgaacgctagcgacaggcttaacacatgcaagtcgaggggcagcatgaaattacttcggtaattttgatggcgaccggcgcacgggtgcgtaacgcgtatgcaacctacccataactcttggatagcccatggaaacgtggattaatacaggatagtctaatgaatctgcatggattttttagtaaagaatttcggttatggatggacatgcgttccattaggtagtaggtgaggtaacggctcacctagcccatgatggataggggttctgagaggaaggtcccccacattggaactgagacacggtccaaactcctacgggaggcagcagtgaggaatattggtcaatggccgaaaggctgaaccagccaggtcgcgtgagggatgactgccctatgggttgtaaacctcttttgtttgggaagaataagctttacgtgtaaagcgatgccggtaccaaacgaata

SEQ ID NO: 4724 - DNA, 490 bp, Unknown
  Ascusbbf_976163, encodes 16S rRNA
agagtttgatcctggctcagaatgaacgctggcggcgtgccttacacatgcaagtcgagcgaggcggggagcaatccccagtcgagcggcgaacgggtgagtaacgcgtggataacctgcctctgagtgggggataacccggggaaactcgggctaataccgcataacattgagagatcaaagggggctcgcaagggctctcgcttggagaggggtccgcgtccgattagctagttggtgaggtaatggctcaccaaggcgacgatcggtagccggcctgagagggtgatcggccacactggaactgagacacggtccagactcctacgggaggcagcagtggggaattttgcgcaatgggcggaagcctgacgcagcaacgccgcgtggaggatgaaggtctttggattgtaaactcctgtcagcagggacgaaggctcctggtttaatacaccaggggattgactgtacctgcagaggaagccccggc

SEQ ID NO: 4725 - DNA, 490 bp, Unknown
  Ascusbbf_975737, encodes 16S rRNA
agagtttgatcctggctcagattgaacgctggcggcacgcttaacacatgcaagtcgaacggttgttagtagcttgctactgacgatagtggcgtacgggtgagtaacgcgtaggaatctgccctacagactgggataacctagggaaacttaggctaatactggatgagttctgaggaagaaagtatttatacgagagtataagtagctgtaggatgagcctgcgttggattagctagttggttaggtaaaggctgaccaaggcgaagatccatagctgttctgagaggaagaccagccacactgggactgagacacggcccagactcctacgggaggcagcagtggggaatattggacaatgggggcaaccctgatccagcgatgccgcgtgtgtgaagaaggcctgcgggttgtaaagcactttagttggggaggagactctgcgcgagcggagtagacgttacccaaagaataagcaccggctaac

SEQ ID NO: 4726 - DNA, 490 bp, Unknown
  Ascusbbf_684869, encodes 16S rRNA
agagtttgatcatggctcaggacgaacgctggcggcgtgcctaacacatgcaagtcgaacgaggtccatccagtggcaacactggtgaagaccgagtggcgaacgggtgagtaacacgtgaggaacctgccccgatctcaggaataacaggtggaaacacctgctaataccggatgccttcaccgcaccgcatgacgtggtgaagaaaggtttaccggatcgggagggcctcgcggcctatcagctagttggtggggtaacggcctaccaaggctccgacgggtagctggtctgagaggacgatcagccacactgggactgagacacggcccagactcctacgggaggcagcagtggggaatcttgcgcaatgggcgaaagcctgacgcagcaacgccgcgtgggggatgaaggccctcgggttgtaaacccctttcagcagggacgaatctgacggtacctgcagaagaaggtccggctaactacgtgc

SEQ ID NO: 4727 - DNA, 490 bp, Unknown
  Ascusbbf_1139853, encodes 16S rRNA
agagtttgatcatggctcaggacgaacgctggcggcgtgcttaacacatgcaagtcgaacgaagcaactaagagtgcttgcacaaatagttgactgagtggcggacgggtgagtaacgcgtgagcgacctaccttaaagagggggacaacagttggaaacgactgctaataccgcataagaccacaatgctgcatggcaaaggggtcaaaggagcaatccgctttaagatgggctcgcgtcccattaggtagttggtgaggtaacggctcaccaagccgacgatgggtagccgacctgagagggtgatcggccacactggaactgagacacggtccagactcctacgggaggcagcagtggggaatattgggcaatgggcgaaagcctgacccagcaacgccgcgtgaaggaagaaggtcttcggattgtaaacttctgtcctatgggaagaaaaaaatgactgtaccataggaggaagctccggctaac

SEQ ID NO: 4728 - DNA, 490 bp, Unknown
  Ascusbbf_419608, encodes 16S rRNA
agatttgatcctggctcaggacgaacgctggcggcgtgcttaacacatgcaagtcgaacgatgaagcccagcttgctgggtggattagtggcgaacgggtgagtaacacgtgggtgatctgccctgcactctgggataagcctgggaaactgggtctaataccggatatgacctcgggatgcatgttctggggtggaaagtttttcggtgcaggatgagcccgcggcctatcagcttgttggtggggtaatggcctaccaaggcgacgacgggtagccggcctgagagggcgaccggccacactgggactgagacacggtccaaactcctacgggaggcagcagtgaggaatattggtcaatggacgagagtctgaaccagccaagtagcgtgcaggatgacggccctatgggttgtaaactgcttttatgcggggataaagtgcgccacgcgtggtgtattgcaggtaccgcaagaataaggaccggct

SEQ ID NO: 4729 - DNA, 490 bp, Unknown
  Ascusbbf_315594, encodes 16S rRNA
gagtttgatcatggctcagaatgaacgttggcggcatggattaggcatgcaagtcgagcgagaagagtcatttgcttgcatttgactcggaaagcggcgtaagggtgagtaacacgtagttacctgcctccgggtccggaatagccacgggaaactgtgggtaatgccggataacatctcaggatcaaaggtgagattccgcccggagaggggactgcgtcctactagcttgttggtggggtaatggcctaccaaggcttcgatgggtagcgggcgtgagagcgtggcccgtcacagtgggactgagacacggcccagactcctacgggaggcagcagtgaggaatattggtcaatggcggcaacgctgaaccagccaagtagtgtgagggattactgccctatgggttttaaacctcttttgttggggagcaaccggcatcacttgtggtgccctgcgagtacccttcgaataagcatcggctaactcc

SEQ ID NO: 4730 - DNA, 488 bp, Unknown
  Ascusbbf_1766874, encodes 16S rRNA
agagtttgatcctggctcaggacgaacgctggcggcgtgcttaacacatgcaagtcgaacgaggtagcaatacctagtggcggacgggtgagtaacacgtaggtaacctgcctcatagtgggggatacccagccgaaaggttggctaataccgcataagctctgcagttggaatactgcagaggaaagatttattgctatgagaggggcctgcgcatgattagctagttggtggggtaatggctcaccaaggcgacgatcattagctggtctgagaggacgatcagccacactggaactgagacacggtccagactcctacgggaggcagcagtggggaattttccgcaatgggcgaaagcctgacggagcaacgccgcgtgggtgatgaagatcttcggatcgtaaagccctttcagcagggacgaagcgagtgacggtacctgcagaagaagcatcggctaactacgtgccagcagccgcggtaat

SEQ ID NO: 4731 - DNA, 490 bp, Unknown
  Ascusbbf_989587, encodes 16S rRNA
agagtttgatcctggctcaggacgaacgctggcggcgtgcttaacacatgcaagtcgagcggaaaggctcctttcggggggtactcgagcggcgaacgggtgagtaacacgtgagtaacctgtccttggctttgggataaccctcggaaacgggggctaataccggatatgactgctgcctgcatgggtggtggtggaaaggtttgttccggccagggttgggctcgcggcctatcagcttgttggtggggtgatggcctaccaaggcggcgacgggtagccggcctgagagggcgaccagccacactgggactgagacacggcccagactcctacgggaggcagcagtggggaatattgcacaatgggcgaaagcctgatgcagcgacgccgcgtgagggatgacggccttcgggttgtaaacctctttcagcaccgacgaagcggaagtgacggtaggtgcagaagaagcgccggccaactacgtgcc

SEQ ID NO: 4732 - DNA, 490 bp, Unknown
  Ascusbbf_1372517, encodes 16S rRNA
agagttttctcctttctccttcttccctctttcttcttgcttcccccctgccagtcgaacggagttatctcgctgaggagagcttgctcaaatcttgagataacttagtggcggacgggtgggtaacgcgtggataacctgccttataccgggggataacacttagaaataggtgctaataccgcataagcgcacgatcccgcatgggaaagtgtgaaaaactcctgtggtataagatggatccgcgtctgtttagatagttggtgaggtaacggcccaccaagtcaacgatcagtcgccggcctgggcgggtgaacggccacatagggactgagacacggccaaaactcctacgggcggaagcagtggggaatattgcacaatgggggaaaacctgatgcagcgacgccgcgtgagtgaagaagtatttcggtatgtaaagctctatcagcaaggaagaaaaaaatgacggtacttgactaagaagccc

SEQ ID NO: 4733 - DNA, 490 bp, Unknown
  Ascusbbf_1298638, encodes 16S rRNA
agagtttgatcctggctcaggatgaacgctggcggcgtgcttaacacatgcaagtcgaacgaagcatttcagtgaatttcttcggattgaagctgatctgactgagtggcggacgggtgagtaacgcgtgggtaacctgccttacacagggggacaacagagggaaacttctgctaataccgcataacccgctaatgtcgcatgacatagacggaaaagatttatcggtgtaagatggacccgcgtctgattagccagttggtggggtaacggcctaccaaagcgacgatcagtagccgaactgagaggttgaccggccacattgggactgagacacggcccagactcctacgggaggcagcagtggggaatattgcacaatgggggaaaccctgatgcagcaacgccgcatgagtgaagaagtatttcggtatgtaaagctctatcagcagggaagagattgacggtacctgactaagaagccccggct

SEQ ID NO: 4734 - DNA, 490 bp, Unknown
  Ascusbbf_1585472, encodes 16S rRNA
agagtttgatctggctcaggatgaacgctggcggcgtgcataacacattcaagtcgaacggtgaagtcccttcggggacggatcagtggcggacgggtgagtaacgcgtgagcaacctgcctcatactcagggataacacagggaaacttgtgctaataccggataacgtattgggactgcatggttctgatatcaaagctccggtggtgtgagatggactcgcgtatgattagatagttggcagggtaacggcctaccaagtctgcgatcattagccgaactgagaggttgaacggccacattggaactgagaaacggtccagactcctacgggaggcagcagtggggaatattgggcaatgggcgaaagcctgacccagcgacgccgcgtgcgggaagacggtcttcggattgtaaaccgctttcagcagggaagaagcaagtgacggtacctgcagaagaagtcacggctaactacgtgccagcagc

SEQ ID NO: 4735 - DNA, 490 bp, Unknown
  Ascusbbf_899980, encodes 16S rRNA
agagttgatcatggctcaggacgaacgctggcggcgtgcttaacacatgcaagtcgaacggggatatccgtgcggaaggcttcggccggaagggtggatattcgagtggcggacgggtgagtaacgcgtgaacaatctgtcccggacagggggataacacttggaaacaggtgctaataccgcataagaccacagcatcgcatggtgcgggggtaaaaggggaaacgcggttcggggtgagttcgcgtccgattagatagttggtgaggtaacggcccaccaagtcgacgatcggtagccggactgagaggtcgatcggccacattgggactgagacacggcccagactcctacgggaggcagcagtgggggatattgcacaatgggcgcaagcctgatgcagcaacgccgcgtgagggaggacggtcttcggattgtaaacctctgtccttggggaagaaacaaatgacggtacccttggaggaagcca

SEQ ID NO: 4736 - DNA, 488 bp, Unknown
  Ascusbbf_1537254, encodes 16S rRNA
agagtttgatcctggctcagaacgaacgctggcggcaggcttaacacatgcaagtcgaacgccccgcaaggggagtggcagacgggtgagtaacgcgtgggaatctacctagttctacggaacaacagttggaaacgactgctaataccgtatacgccctacgggggaaagatttgtcggaattagatgagcccgcgtgagattagctagttggtggggtaatggcctaccaaggcgacgatctctagctggtctgagaggatgatcagccacactgggactgagacacggcccagactcctacgggaggcagcagtgaggaatattggtcaatggaggcaactctgaaccagccaagtagcgtgcaggacgacggccctacgggttgtaaactgcttttatgcggggataaacggcattacgtgtagtgctttgcaggtaccgcatgaataaggaccggctaattccgtgccagcagccgcggtaat

SEQ ID NO: 4737 - DNA, 490 bp, Unknown
  Ascusbbf_758650, encodes 16S rRNA
agagtttgatcatggctcagattgaacgctggcggcaggcctaacacatgcaagtcgagcgcgaaaggttcttcggagctgagtagagcggcggacgggtgagtaatgcgtaggaatctacctggtagtgggggataacttggggaaactcaagctaataccgcatacgccccatgggggaaagcgggggatcttcggacctcgtgctatcggaagagcctgcgtaggattagcttgttggtgaggtaatggctcaccaaggcgacgatccttagctggtctgagaggatgatcagccacaccgggactgagacacggcccggactcctacgggaggcagcagtggggaatattgcgcaatgggggaaaccctgacgcagccatgccgcgtgtgtgaagaaggccttcgggttgtaaagcacttttgcattcgaggaagacagcacgtaaataaacgtgttatttgacgttagagtgtgaataagcaccg

SEQ ID NO: 4738 - DNA, 490 bp, Unknown
  Ascusbbf_372858, encodes 16S rRNA
agagtttgatcatggctcagattgaacgctggcggcacgcctaacacatgcaagtcgagcggtaacatggttggagcttgcttcaactgatgacgagcggcggacgggtgaggaacacgtaggaacctgcctagaagagggggacaaccagaggaaactttggctaataccgcataaactcgcgagagaaaagtcgccttagggtggcgcttttagaagggcctgcgtccgattagttagttggtgaggtaactgctcaccaaggcgatgatcggtaactggtctgagaggacggccagtcacactgggactgagacacggcccagactcctacgggaggcagcagtggggaatattggacaatgggggcaaccctgatccagcgatgccgcgtgggtgaagaaggccttcgggttgtaaagccctttaggttgggaagaaaggtagccgtttaagagatagttactgtgacggtaccaacagaataagc

SEQ ID NO: 4739 - DNA, 490 bp, Unknown
  Ascusbbf_596997, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtgagcaacttgcccgtcactggaggataggcactggaaacggtgtgtaatactccataacataagaattcgcatgagtttttattgaaagattcattggtgacggatgggctcgcgagacattagctagacggcggggtaacggcccaccgtggcgatgattggtaggggttctgagaggaaggtcccccacattggaactgagacacggtccaaactcctacgggaggcagcagtgaggaatattggtcaatggccgtaaggctgaaccagccaagtagcgtgcaggatgacggccctatgggttgtaaactgcttttgtatgggaataaagtgcgggacgtgtcccgttttgtatgtaccataagaataagga

SEQ ID NO: 4740 - DNA, 489 bp, Unknown
  Ascusbbf_428733, encodes 16S rRNA
agagtttgatcatggctcagaacgaacgctggcggcaggcttaacacatgcaagttgaacggtattgttaagtagcttgctatttgacaagagagtagcgcactggtgagtaacacgtgggaacgtgccttttagtgggggacaacagttggaaacgactgctaataccgcatacgccctaagggggaaagatttatcgctaaaagatcggcccgcggaagattaggtagtaggtggggtaaaggcctacctagccgacgatctatagctggtctgagaggacgatcagccgcattggaactgagacacggtccagactcctacgggaggcagcagtgaggaatattgcacaatggacgaaagtctgatgcagcaacgccgcgtggaggatgacggcccttgggttgtaaactccttttttcagggaagagtgaggacggtacctgaagaataagtcacggctaactacgtgccagcagccgcggtaat

SEQ ID NO: 4741 - DNA, 490 bp, Unknown
  Ascusbbf_666555, encodes 16S rRNA
agagtttgatcatggctcaggacgaacgctggcggcgtgcttaacacatgcaagtcgaacggtgaaggtggagcttgctctgctggatcagtggcgaacgggtgagtaacacgtgagtaacctgcccctcacttcgggataacctcgggaaatcgtggctaataccggatacgaggcaccttcgcatggggtgtgcctggaaagatttatcggtgggggatggactcacggcctatcagcttgttggtggggtaatggcccaccaaggcgacgacgggtagccggcctgagagggcgaccggccacactgggactgagatacggcccagactcctacgggaggcagcagtgggggatattgcacaatggaggaaactctgatgcagcgatgccgcgtgagtgaagaagtatttcggtatgtaaagctctatcagcagggaagataatgacagtacctgactaagaagccccggctaactacgtgccagca

SEQ ID NO: 4742 - DNA, 490 bp, Unknown
  Ascusbbf_600065, encodes 16S rRNA
agagtttgatcctggctcaggacgaacgctggcggcgtgcttaacacatgcaagtcgaacgagaatctgtggatcgaggattcgcccaagtgaagcagaggatagtggcggacgggtgagtaacgcgtgaggaacctgcctttcagagggggacaacagttggaaacgactgctaataccgcatgatacatttgggtggcatcatctgaatgtcaaagatttatcgctgaaagatggcctcgcgtctgattagctagttggtaaggtaacggcttaccaaggcgatgatcagtagccggcctgagagggtgatcggccacattgggactgagacacggcccaaactcctacgggaggcagcagtggggaatattgcacaatggaggaaactctgatgcagcgacgccgcgtgagcgaagaagggattcgtctcgtaaagctctgtcctatgggaagataatgacggtaccatagaagaaagccccggcta

SEQ ID NO: 4743 - DNA, 490 bp, Unknown
  Ascusbbf_1603353, encodes 16S rRNA
agagtttgatcctggctcagaacgaacgctggcggcgcgtcttaagcatgcaagtcgagcgggatgaagtggcttgccacttctgagagcggcggactggcgaggaacgcgtgggcgacgcgccctcgggaccgggacagcccgtggaaacacggggtaataccggatggaatgggaggcttggaggccttccatcaaaggggcttcggccccgccggaggagcggcccgcgacccatcagctagttggcggtgcaagggaccaccaaggctgcgacgggtatccggcctgagagggcgaacggacgcattgggactgagatacggcccagactcctacgggaggcagcagtcgggaatattgcgcaatggaggaaactctgacgcagtgacgccgcgtgcaggaagaaggttttcgaattgtaaactgctttagacagggacgaaaaaaatgacggtacctgtagaataagctccggctaactacgtgc

SEQ ID NO: 4744 - DNA, 490 bp, Unknown
  Ascusbbf_1377302, encodes 16S rRNA
agagtttgatcatggctcaggatgaacgctagcggcaggcttaatacatgcaagtcgagggggattaacattgtagcaatacgaagttatgagaccggcaaacgggtgaggaacacgtacgcaactttcccaaaactggtgaatagccctccgaaaggaggattaatacaccgtaacatcccgacacggcatcgtgctgggattatagctccggcggttttggatggtcgtgcgcctgattaggtagttggcggggtaacggcccaccaagcctgcgatcagtaactggtgtgagagcacgaccagtcagacgggaactagaacacgggcccgactcctacgggatgcagcagtaaggaatattggtcaatggacgaaagtctgaaccagccatgccgcgtgaaggattaaggccctctgggttgtaaacttcttttatctgggacgaaaaaagggtattcttacccacttgacggtaccagaggaataa

SEQ ID NO: 4745 - DNA, 477 bp, Unknown
  Ascusbbf_1338568, encodes 16S rRNA
agagtttgatcatggctcaggatgaacgctagctacaggcttaacacatgcaagtcgaggggcagcatgaagtttgcttgcaaactttgatggcgaccggcgcacgggtgagtaacgcgtatccaaccttccccttagtagggcatagcccggcgaaagtcggattaataccctatgttttccaatgaggacatctgagctggaacaaagattcatcgctaagggatggggatgcaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatacggggataaagtgagggacgtgtccctttttgtaggtaccgtatgaataaggaccggctaattccgtgccagcagccgcggtaat

SEQ ID NO: 4746 - DNA, 472 bp, Unknown
  Ascusbbf_1409457, encodes 16S rRNA
agagtttgatcatggctcagagcgaacattggcggtaggcttaacacatgcaagtcgagcgaggcgtaatagtcgagcggcgaacgggtgagtaatacatggaaatctaccctgaagtggggataacgtccagaaatggacgctaataccgcataatccatattgggaaagcgttgcagcgctttaggatgagtccatggctgattagcttgttggtgaggtaatggctcaccaaggcgacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttaagggggaagagcagaagacggtacccctagaataagccacggctaactacgtgccagcagccgcggtaat

SEQ ID NO: 4747 - DNA, 473 bp, Unknown
  Ascusbbf_460192, encodes 16S rRNA
agagtttgatcatggctcaggatgaacgctggcggcgtgcctaatacatgcaagtcgagcggtaacacttcgggtgacgagcggcggacggctgagtaacacgtaggaacgtaccccaaagtgagggataagcaccagaaatggtgtctaataccgcatatgctcttcggaggaaagcttcggcgctttgggaacggcctgcgcatgattagcttgttggtgaggtaatggcttaccaaggcgacgatcattagctggtctgagaggatgatcagccagactgggactgagaacggcccagactcctacgggaggcagcagtagggaattttccacaatgggcgaaagcctgatggagcaacgccgcgtgcaggatgaaggcctttgggctgtaaactgcttttattggtgacgattatgacggtagccaatgaataaggatcggctaactccgtgccagcagccgcggtaat

SEQ ID NO: 4748 - DNA, 490 bp, Unknown
  Ascusbbf_1507162, encodes 16S rRNA
agagtttgatcatggctcaggacgaacgctggcggcgtgcttaacacatgcaagtcggacggtaaggcccttcggggtacacgagtggcgaacgggtgagtaacgcgtgagtaacctgcccctgactttgggataacggatggaaacgtctgctaataccgaatattcagttctccgggcatccggggggttggaaagttttttcggtcagggatggactcgcgtcctatcagcttgttggtggggtaatggcctaccaaggcgtcgacgggtagccggcctgagagggcgaccggccacattgggactgagatacggcccagactcctacgggaggcagcagtggggaatattgcacaatggacgaaagtctgatgcagcaacgccgcgtgcgggatgacggccttcgggttgtaaaccgctttcagccatgacgaagcgaaagtgacggtagtggcagaagaagcaccggctaactacgtgccagcag

SEQ ID NO: 4749 - DNA, 490 bp, Unknown
  Ascusbbf_796064, encodes 16S rRNA
agagtttgatcatggctcaggatgaatgctagctacaggcctaacacatgcaagtcgaggggcagcatggagaaagcttgctttctctgatggcgaccggcgaatgggtgagtcacgcgtgtccaacctgcctccggcccggggatagcccttggaaatgaggattaagacccgatacgtgcgcgttccgcatggcgtgcgcatgaaacaggaccggagatggggacgcgtcggattagctggacggctgggcaaaggcccaccgtggcgacgatccgcaggggttctgagaggaaggtcccccacactggcactgagacacgggccagactcctacgggaggcagcagtgaggaatattggtcaatggccgcgaggctgaaccagccaagtagcgtgcaggacgacggccctatgggttgtaaactgcttttatgcggggataaagttcgccatgcgtggtgttttgcatgtaccgcatgaataaggac

SEQ ID NO: 4750 - DNA, 490 bp, Unknown
  Ascusbbf_896334, encodes 16S rRNA
agagtttgatcctggctcaggatgaacgctggcggcgtgcttaacacatgcaagtcgaacgaagaaggttagaatgagagcttcggcaggatttctatctatcttagtggcggacgggtgagtaacgcgtgagcaacctgcctttcagagggggataacgtcttgaaaaggacgctaataccgcatgagatcgtagttccacatggaatagcgaccaaaggagcaatccgctgaaagatgggctcgcgtccgattagatagttggcggggtaacggcccaccaagtcgacgatcggtagccggactgagaggttgaacggccacattgggactgagacacggcccagactcctacgggaggcagcagtgagggatattggtcaatgggggaaaccctgaaccagcaacgccgcgtgagggatgacggtcttcggattgtaaacctctgtcctctgtgaagataatgacggtagcagaggaggaagccccg

SEQ ID NO: 4751 - DNA, 173 bp, Unknown
  Ascusbbf_399430, encodes 16S rRNA
agagtttgatcctggctcagcagccgcggtaatgccagcagccgcggtaatctgtctcttatacacagagtttgatcatggctcagccagcagccgcggtaatgccagcagccgcggtaatctgtctcttatacacagagtttgatcatggctcagccagcagccgcggtaat

SEQ ID NO: 4752 - DNA, 490 bp, Unknown
  Ascusbbf_333214, encodes 16S rRNA
agagtttgatcctggctcaggacgaacgctggcggcgtgcctaacacatgcaagtcgagcggggattgtggagagcttgctcaaagcaattctagcggcggacgggtgagtaacgcgtgagcaacctgcctttcacagggggataacgcatcgaaagatgtgctaataccgcgtaagaccacggtgtcgcatgacacaggggtcaaaggagcaatccggtgagagatgggctcgcgtccgattagctagttggtgagataacagcccaccaaggcgacgatcggtagccgacctgagagggtgatcggccacattggaactgagagacggtccagactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggctaactacgtg

SEQ ID NO: 4753 - DNA, 481 bp, Unknown
  Ascusbbf_1357332, encodes 16S rRNA
agagtttgatcatggctcaggatgaacgctggcggcgtgcctaatacatgcaagtcgagcggtaaggccccttcgggggtacacgagcggcggacggctgagtaacacgtaggaacgtaccccaaagtgagggataagcaccggaaacggtgtctaataccgcatgtggtcttcggattaaagctttatgcgctttgggagcggcctgcgtaagattagcttgttggtgaggtaagagctcaccaaggcgacgatctttagctggtctgagaggatgatcagccagactgggactgagacacggcccagactcctacgggaggcagcagtagggaattttccacaatgggcgaaagcctgatggagcaacgccgcgtgcaggatgaaggccttagggtcgtaaactgcttttatatgtgaagattatgacggtagcatatgaataaggatcggctaactccgtgccagcagccgcggtaat

SEQ ID NO: 4754 - DNA, 490 bp, Unknown
  Ascusbbf_322344, encodes 16S rRNA
agagtttgatcctggctcaggatgaacgctggcggcgtgcctaacacatgcaagtcgaacgaagcgtctcgatattttcggatggagagatgactgagtggcggacgggtgagtaacgcgtgggtaacctgcctcacactgggggacaacagttagaaatgactgctaataccgcataagcgcacagtactgcgtggtacagtgtgaaaaactccggtggtgtgagatggacccgcgtctgattagctagttggtggggtaacggcctaccaaggcgacgatcagtagccgacctgagagggtgaccggccacattgggactgagacacggaccaaactcctacgggaggcagcagtgaggaatattggtcaatgggcgaaagcctgaaccagccaagtagcgtgcaggacgacggccctatgggttgtaaactgcttttataggggaataaagttatccacgtgtggatatttgcatgtaccctatgaa

SEQ ID NO: 4755 - DNA, 490 bp, Unknown
  Ascusbbf_1616127, encodes 16S rRNA
agagttgatcctggctcaggatgaacgctagcgacaggcttaacacatgcaagtcgaggggcagcgggggcgatggcaacattgcccgccggcgaccggcgcactggtgagtaacacgtatgcaacctgccccgcacagggggataacccagagaaatttggcctaataccccgtaacaccgtcgggggcatccccggtggttgaaagaggcgactcggtgcgggatgggcatgcggcgcattagatagttggcggggcgacggcccaccaagtcgacgatgcgtaggggttctgagaggaaggtcccccacattggtactgagacacggaccaaactcctacgggaggcagcagtgaggaatattggtcaatgggcgaaagcctgaaccagccaagtagcgtgcaggatgacggccctatgggttgtaaactgcttttataggggaataaagttatccacgtgtggatatttgcatgtaccctatgaat

SEQ ID NO: 4756 - DNA, 490 bp, Unknown
  Ascusbbf_538427, encodes 16S rRNA
agagtttgatcctggctcaggacgaacgctggcggcgtgcctaacacatgcaagtcgaacgaagaaattgttttcggatgatttcttagtggcggacgggtgtgtaacgcgtgaataacctgcccttcagagtggaatagcgtttggaaacgaacggtaataccgcataatatcaacggatcgcatggtctgatgatcaaaggggaaactcgctgaaggatggattcgcgtccgattagccagttggcggggtaacggcccaccaaagcgacgatcggtagccagactgagaggtcgaacggccacattgggactgagacacggcccagactcctacgggaggcagcagtgggggatattgcacaatggaggaaactctgatgcagcaacgccgcgtgagggaagaaggttttcggattgtaaacctctgtctttggtgaagaagaagacggtagccaaggaggaagctccggctaactacgtgccagca

SEQ ID NO: 4757 - DNA, 490 bp, Unknown
  Ascusbbf_1559906, encodes 16S rRNA
agagtttgatcatggctcaggacgaacgctggcggcgtgcttaacacatgcaagtcgaacgaggattatttgggagcttgctcccgggtaatccgagtggcggacgggtgagtaacgcgtgaacaatctgtctcatacagggggataacgcatcgaaagatgtgctaataccgcatatgaccacgccggggcatcccggagaggtgaaaggagcaatccggtatgaggtgagttcgcgtctgattagatagttggtggggtaacggcccaccaagtcgacgatcagtagccggactgagaggttgaacggccacattgggactgagatacggcccagactcctacgggaggcagcagtggggaatattgggcaatgggcgcaagcctgacccagcaacgccgcgtgaaggaagaaggctttcgggttgtaaacttcttttaagggggaagagcagaagacggtacccctagaataagccacggctaacta

SEQ ID NO: 4758 - DNA, 490 bp, Unknown
  Ascusbbf_754148, encodes 16S rRNA
agagtttgatcatggctcagaacgaacgctggcggcaggcttaacacatgcaagtcgaacgcccctccttcaagcaagcttgaaggatttcttccttgtgaaggatttcaagcaagctgggcttgcttgatggaggggagtggcagacgggtgagtaacgcgtgggaatctacctatctctacggaataacccagggaaacttggactaataccgtatacgcccttttggggaaagatttatcggggatggatgagcccgcgttggattagctagttggtggggtaagggcctaccaaggcgacgatccatagctggtctgagaggatgatcagccacattgggactgagacacggcccaaactcctacgggaggcagcagtggggaatattggacaatgggcgcaagcctgatccagccatgccgcgtgagtgatgaaggccctagggttgtaaagctctttcaacggtgaagataatgacggtaaccg

SEQ ID NO: 4759 - DNA, 490 bp, Unknown
  Ascusbbf_1551772, encodes 16S rRNA
agagtttgatcctggctcaggatgaacgctggcggcgtgcctaacacatgcaagtcgaacggcagcatggtctagcttgctagactgatggcgagtggcggacgggtgagtaacgcgtgggaatatgccttaaagagggggacaacctggggaaactcaggctaataccgcatatgctctgaggagtaaagctggggacttttaagcctggcgctttaagaatagcctgcgtccgattagctagttggtggggtaagggcctaccaaggcgacgatcggtagctggtctgagaggacgaacagccacactgggactgagacacggcccagactcctacgggaggcagcagtagggaattttgcgcaatgggcgaaagcctgacgcagcaacgccgcgtgatcgagacgcttttcggagtgtaaagatctgtcagtggggacgaagaatgactgtacccacagaggaagcaccggctaactccgtgccagc

SEQ ID NO: 4760 - DNA, 490 bp, Unknown
  Ascusbbf_573133, encodes 16S rRNA
agagtttgatcctggctcagagcgaacgctggcggcaggcctaacacatgcaagtcgagcgcccagcaatgggagcggcagacgggtgagtaacgcgtggggatctacccattggtacggaataacccagggaaacttggactaataccgtatgtgcccttcgggggaaagatttatcgccaatggatgaacccgcgtctgattagctagttggtgaggtaaaggctcaccaaggcgacgatcagtagctggtctgagaggatgatcagccacactgggactgagacacggcccagactcctacgggaggcagcagtggggaatattggacaatgggcgcaagcctgatccagccatgccgcgtgagtgatgaaggccttagggttgtaaagcacttttgcattcgaggaagacagcacgtaaataaacgtgttatttgacgttagagtgtgaataagcaccggcaaactccgtgccagcagccgcggta

SEQ ID NO: 4761 - DNA, 490 bp, Unknown
  Ascusbbf_1550542, encodes 16S rRNA
agagtttgatcctggctcagattgaacgctggcggcaggcttaacacatgcaagtcgaacggaaaggccccgctcgcggggtactcgagtggcgaacgggtgagtaacacgtgggtgatctgccctgcacttcgggataagcctgggaaactgggtctaataccggatatgacttccctttagtgtggggggtggaaagatttatcggtgcaggatgagcccgcggcctatcagcttgttggtggggtaatggcctaccaaggcgtcgacgggtagccggcctgagagggtgatcggccaaactgggactgagacacggcccagactcctacgggagacagcagttaggaatattcgtcaatgggggaaaccctgaacgagcaatgccgcgtgaaggatgaaggtcctatggattgtaaactgcttttgtacggggataaagtgagtcacgtgtggcttattgcaggtaccgtacgaataaggaccggct

SEQ ID NO: 4762 - DNA, 490 bp, Unknown
  Ascusbbf_1322051, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttccggatgggctggcgtgacattagctagttggtaaggtaacggcttaccaaggcgatgatgtctaggggagctgagaggcttatctccgtagatggtacagtggaacggaccagactcctacgggaggcagcagtgaggaatattggtcaatggacggaagtctgaaccagccatgacgcgtggaggaagaaggtcctatgggttgtaaactccttttgttcgagagtaataagggctttgcgaagcccgatgagagtatcggacgaataagc

SEQ ID NO: 4763 - DNA, 490 bp, Unknown
  Ascusbbf_1301251, encodes 16S rRNA
agagtttgatcctggctcaggatgaacgctagctacaggcttaacacatgcaagtcgaggggcatcatgggaggacttcggtccttttgatggcgaccggcgcacgggtgagtaacgcgtatccaaccttccccctactcaggcatagcccggtgaaaaccggattaactcctgatagtttcactagatggcatctgacggtgaataaagctctgcggtaagggatggggatgcgtctgattagcttgttggcggggtaacggcccaccaagcctacgatcagtaggggttctgagaggaaggtcccccacattggaactgagacacggtccaaactcctacgggaggcagcagtgaggaatattggtcaatggacgaaagtctgaaccagccaagtagcgtgcaggacgacggccctatgggttgtaaactgcttttatgcggggataaagtgcgccacgcgtggtgtattgcaggtaccgcaagaata

SEQ ID NO: 4764 - DNA, 490 bp, Unknown
  Ascusbbf_1301849, encodes 16S rRNA
agagtttgatcctggtcaggacgaacgctggcggcgtgcctaacacatgcaagtcgagcgagaatctttcattggaacccttcggggtgaagaaggaagaggagagcggcggacgggtgagtaacgcgtgagcaacctgccttaaggagggggataacacagggaaacctgtgctaataccgcataatatatatttaccgcatggtagatatatcaaaactccggtgccttaagatgggctcgcgtccaattagctagttggaggggtaacggcccaccaaggcaacgattggtagccggactgagaggttgaacggccacattggaactgagaaacggtccagactcctacgggaggcagcagtgggggatattgcccaatgggggaaaccctgatgcagcgacgccgcgtgaaggaagaagtatctcggtgtgtaaacttctatcagcagggaagataatgacggtacctgactaagaagccccggct

SEQ ID NO: 4765 - DNA, 469 bp, Unknown
  Ascusbbf_1510709, encodes 16S rRNA
agagtttgatcctggctcagagcgaacgctggcggcaggcctaacacatgcaagtcgagcgccctttcgggggagcggcagacgggtgagtaacgcgtggggatctacccattggtacggaataactctgggaaactggaactaataccgtatgagcccttcgggggaaagatttatcgccaatggatgaacccgcgtcagattagctagttggtggggtaaaggctcaccaaggcgacgatctgtagctggtctgagaggatgatcagccacactgggactgagacacggcccagactcctacgggaggcagcagtggggaatattggacaatgggcgcaagcctgatccagccatgccgcgtgtgtgtagaaggccttcgggttgtaaagcactttcggaggggaggaacaaatgacgttaccctcagaagaagcaccggctaactccgtgccagcagccgcggtat

SEQ ID NO: 4766 - DNA, 490 bp, Unknown
  Ascusbbf_796309, encodes 16S rRNA
agagtttgatcctggctcaggttgaacgctggcgtcatgcttaacacatgcaagtcgaacgagaatttataaaaattttagctccggcttttatttttattttttttagtggcggacgggtgagtaacgcgtaagaacctaccttatggtgagggataccaactggaaacggttgctaatacctcatatgctgagaagtaaaaggtttacatcgccataagaggggcttgcgtctgattagttagttggtggggtaaaggcttaccaagactatgatcagtagttggtctgagaggacgatcagccacactgggactgagacacggcccagactcctacgggaggcagcagtgaggaattttccgcaatgggcgaaagcctgacggagcaatgtcgcgtggaggaagaaggcccgtgggtcgtaaactccttttgtcaaaaaagaaaaaatgacggtatttgacgaataagcattggctaactttgtgcc

SEQ ID NO: 4767 - DNA, 490 bp, Unknown
  Ascusbbf_1851627, encodes 16S rRNA
agagtttgatcctggctcaggatgaacgctagcggcaggcttaacacatgcaagtcgaggggcagcgggagtagcaatacttgccggcgaccggcgcacgggtgcgtaacgcgtatgcaacctacctataacagggggataatccggagaaatctggtctaataccccataacacttagtacggcatcgtacatagttgaaattttcggaggttatagatgggcatgcgtgacattagctagatggtgaggtaacggctcaccatggcaacgatgtctagggggactgagaggttaaccccccacactggtactgagacacggaccagactcctacgggaggcagcagtgaggaatattggtcaatggacggaagtctgaaccagccatgccgcgtgcaggatgacggctctatgagttgtaaactgcttttatacgagggtaaagtgggttacgtgtaaccttttgaaagtatcgtatgaataaggatc

SEQ ID NO: 4768 - DNA, 490 bp, Unknown
  Ascusbbf_1491811, encodes 16S rRNA
agagtttgatcctggctcaggacgaacgctggcggcgtgcctaacacatgcaagtcgaacggagtaattgcttcggtgattacttagtggcgaacgggtgagtaacgcgtgaggaacctgcctttcagtgggggacaacagttggaaacgactgctaataccgcataatgttatcgggtcgcatggcctggtaaccaaagatttattgctgaaagatgggctcgcgtccgattaggtagttggtgaggcaacggctcaccaagccgacgatcggtagccggactgagaggtcgatcggccacattgggactgagacacggcccagactcctacgggaggcagcagtgggggatattgcacaatgggcgcaagcctgatgcagcaacgccgcgtgagggaggacggtcttcggattgtaaacctctgtccttggggaagaaacaaatgacggtacccttggaggaagccacggctaactacgtgccagcag

SEQ ID NO: 4769 - DNA, 294 bp, Unknown
  Ascusbbf_1191691, encodes 16S rRNA
agagtttgatcatggctcagaacgaacgctggcggcacgcttaacacatgcaagtcgaacggtgcaatggggcttgctctattgcatagtggcggacgggtgagtaacacgtaggaacctacctggtaatggtggatagcttcgggaaactggaggtaatacagcatgagctcgagagaggaaaggccataaggtcgttaccagaggggcctgcggatgattaggtagttggtggggtaaaggcctaccaagccgacgatcaatagctggtctgaggccagcagccgcggtaat

SEQ ID NO: 4770 - DNA, 490 bp, Unknown
  Ascusbbf_610727, encodes 16S rRNA
agagtttgatcctggctcagattgaacgctggcggcaggcttaacacatgcaagtcgaacgatgagtatctagcttgctagatgcgattagtggcgaacgggtgagtaatgcttaggaatctgcctagtagtgggggatagcttggggaaacccaaattaataccgcatacgtcttacgagagaaagggggcttttagctctcgctattagatgagcctaagtcggattagctagttggtggggtaaaggcctaccaaggcgacgatctgtagctggtcttagaggatgatcagccacactgggactgagacacggcccagactcctacgggaggcagcagtggggaatattggacaatgggcgaaagcctgatccagccatgccgcgtgtgtgaagaaggccttttggttgtaaagcactttaagtggggaggaaaagctgttgattaatacccaatagccctgacgttacccacagaataagcaccgg

SEQ ID NO: 4771 - DNA, 490 bp, Unknown
  Ascusbbf_1111649, encodes 16S rRNA
agagtttgatcctggctcaggataaacgctagcggcaggcctaacacatgcaagtcgaggggcagcggatagagtagcttgctactcttgccggcgaccggcgcacgggtgcgtaacgcgtatgcaacctacctttaacaggggcataacactgagaaatcggtactaattccccataatatttcgagaggcatctcttgaggttgaaaactccggtggttaaagatgggcatgcgttgtattagctagttggtgaggtaacggctcaccaaggcgacgatacatagggggactgagaggttaaccccccacactggtactgagacacggaccagactcctacgggaggcagcagtgaggaatattggtcaatggacgcaagtctgaaccagccatgccgcgtgcaggatgacagctctatgagtcgtaaactgcttttgcagaagggtaaacccggatacgtgtatccggctgaaagtactctgcgaat

SEQ ID NO: 4772 - DNA, 490 bp, Unknown
  Ascusbbf_1569571, encodes 16S rRNA
agagtttgatcatggctcaggacgaacgctggcggcgggcttaacacatgcaagtcgcgggagagccggaccttcgggtccggggagaccggcggatgggtgagtaaagcgtaggtaatctaccgtaaggacggggataacatcgcgaaagcggtgctaataccggatgatgcagcggggccgcatggccacagttgttaaatctgccttagggcgggccttatgatgaacctgcgtgccattagttagttggtagggtaacggcctaccaagacgatgatggctagggggtctgagaggatgatcccccacactgggactgagacacggcccagactcctacgggaggcagcagtgaggaatcttgcgcaatgggggcaaccctgacgcagccacgccgcgtgctggaagacggccctatgggttgtaaactgcttttataggggaataaagttatccacgtgtggatatttgcatgtaccctatgaat

SEQ ID NO: 4773 - DNA, 285 bp, Unknown
  Ascusbbf_969245, encodes 16S rRNA
agagtttgatcctggctcaggatgaacgctggcggcgtgcctaacacatgcaagtcgaacgaagttgtttccacccgacagattatcttcggatatgaagtcaccggaaacgcttagtggcggacgggtgagtaacgcgtgggcaacctgccctacaaaccctgatgcagcgacgccgcgtgagcgatgaagtatttcggtatgtaaagctctatcagcagggaagataatgacggtacctgactaagaagccccggctaaatacgtgccagcagccgcggtaat

SEQ ID NO: 4774 - DNA, 490 bp, Unknown
  Ascusbbf_574454, encodes 16S rRNA
agagtttgatcctggctcagaatgaacgctggcggcgtgcctaacacatgcaagtcgagcgagaaaagtcttcggacttagtaaagcggcgaacgggtgagtaacgcgtgagaatctaccttttggtgaagaataccctcgagaaatcgaggttaatactgcatacgtctcgtaagagagaaaggcggctttatgctgtcgccgaaagatgagcttgcgtactattagctagttggtgaggtaatggcttaccaaggcgatgatggttaaccggcctgagagggtgtacggtcacattggaacttagacacggtccagactcctacgggaggcagcagtgaggaatattgcgcaatgggcgaaagcctgacgcagcgacgccgcgtgagggatgaaggttttaggatcgtaaacctctgttaagtgggaagaaaacccaagctctaatacagtttgggactgacggtaccattagagaaagcaccggcta

SEQ ID NO: 4775 - DNA, 490 bp, Unknown
  Ascusbbf_1772042, encodes 16S rRNA
agagtttgatcatggctcaggatgaacgctagcggcaggcttaatacatgcaagtcgtggggcagcaggggtagcaatacccgctggcgaccggcaaacgggtgaggaacatgtacgcaacctacctttaactggaggatagcccctcgaaagagggattaatactccgtaacatcccgacacagcattgtgacgggattatagctccggcggttaaagatgggcgtgcacctgattagatagttggcggggtaatggcccaccaagtctgcgatcagtaattggtgtgagagcacgaccagtcacacgggcactgagacacgggcccgactcctacgggaggcagcagtaaggaatattggtcaatggacgaaagtctgaaccagccatgccgcgtggaggattaaggccctctgggttgtaaactccttttatctgggaagaaatgcattttttctaaaatgcttgacggtaccagaggaataagcac

SEQ ID NO: 4776 - DNA, 490 bp, Unknown
  Ascusbbf_803678, encodes 16S rRNA
agagtttgatcctggctcagattgaacgctggcggcatggttaaaacatgcaagtcgaacgcgaacgggacttcggtccttagtagagtggcgaaagggcgagtaatgcgtttctaacgtgccccaaggtcagggatagcccagggaaacctggattaatacctgatgaccccgcagcgtcgcatggcgccgcgggcaaaggcttgctgccttgggttcgggaaacgtcctatcagcttgttggtaaggtaacggcttaccaaggctaagacgggtagcgggtgtgagagcacggcccgccgcatcgggactgagacactgcccggactcctacgggaggctgcagtaacgaatattggacaatgcgcgaaagcgtaatccagcaatgccgcgtgcaggatgaagcccctcggggtgtaaactgctgtcaggagctaccaacacaatgaggagctccagaggaagagccggccaactctgtgccagcagc

SEQ ID NO: 4777 - DNA, 490 bp, Unknown
  Ascusbbf_528216, encodes 16S rRNA
agagtttgatcatggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatactccgccccctccgcatgggaggggcgggaaagctccggtggatagagatgggcccgcgttagattggccagttggcggggtaacggcccaccaaagcgacgatctatagccggcctgagagggcgaccggccacattgggactgagacacggcccaaactcctacgggaggcagcagtggggaatattgcacaatgggggaaaccctgatgcagcgacgccgcgtgagtgaagaagtatttcggtatgtaaagctctatcagcagggaagaaaaaggacggtacctgcacaagaagccccggctaactacgtgccagcag

SEQ ID NO: 4778 - DNA, 490 bp, Unknown
  Ascusbbf_765134, encodes 16S rRNA
agagtttgatcctggctcaggatgaacgctagctacaggcttaacacatgcaagtcgaggggcagcatgaagtttgcttgcaaactttgatggcgaccggcggatgggtgagtaacgcgtatccaacctgcccccttcccgggcacagcccttggaaacaaggattaactcccgatggtgtcagtcaggcgcatgcctttctgaccaaatgtttaaggaaggggatggggatgcgtcccattagcttgttgacggggtaacggcccaccaaggctccgatgggtaggggttctgagaggaaggtcccccacactggaactgagacacggtccagactcctacgggaggcagcagtgaggaatattggtcaatggaggcaactctgaaccagccaagtagcgtgagggatgaccgccctacgggttgtaaacctcttttgtcggggaataaaccgcgccacgtgtggcgccctgcatgtacccgcagaata

SEQ ID NO: 4779 - DNA, 490 bp, Unknown
  Ascusbbf_1657164, encodes 16S rRNA
agagtttgatcctggctcaggacgaacgctggcggcgtgcttaacacatgcaagtcgaacggtgacgagcagcttgctgctctgatcagtggcgaacgggtgagtaacacgtgagcaacctacccttgactccgggataacagctggaaacagctgctaataccggatacgacctcgaccgacatcagttgaggtggaaagttctggcggtcaaggatgggctcgcggcctatcagctagttggtgaggtaacggctcaccaaggcttcgacgggtagccggcctgagagggcgaccggccacactgggactgagatacggcccagactcctacgggaggcagcagtgaggaatattggtcaatggacgagagtctgaaccagccaagtagcgtgcaggacgacggccctatgggttgtaaactgcttttatgcggggataaagtgcgccacgtgtggtgtattgcaggtaccgcaagaataaggaccgg

SEQ ID NO: 4780 - DNA, 490 bp, Unknown
  Ascusbbf_917079, encodes 16S rRNA
agagtttgatcctggctcaggacgaacgctggcggcgtgcttcatacatgcaagtcgaacgagaagttaccttcgggtaatggacaatggcggacgggtgagtaaaatgtagagaatctgcccttgagatggggacaacagttggaaacgactgctaatacccaatatgcgcgtagttgagatactattcttgaaagatttatcgcttcaggatgagtctgcatctgattagctagttggaggtgtgatggaccaccaaggcgacgatcagtagctggtttgagaggatgatcagccacaatgggactgagacacggcccatactcctacgggaggcagcagtagggaattttgcgcaatgggggaaaccctgacgcagcaacgccgcgtgaatgaagaagcccttcggggtgtaaagttctgtcagtggggacgaaacttgacggtagccacagaggaagcatcggctaactccgtgccagcagccgcg

SEQ ID NO: 4781 - DNA, 490 bp, Unknown
  Ascusbbf_915129, encodes 16S rRNA
agagtttgatcctggctcaggatgaacgctagctacaggcttaacacatgcaagtcgcggggcatcatggcatgtagcaatacatgctgatggcgaccggcggatgggtgagtaacgcgtatccaacctggccctatctcgggtacagcccctcgaaagagggattaattcccgatgttccctggtatccgcatgttttccagggcaaaggcatttgtcggatagggatggggatgcgttccattaggcagtcggcggggcaacggcccaccaaggcgactatgggtagctgggttgagagaccgaccagccagattgggactgagacacggcccagactcctacgggaggcagcagtggggaatcttgcgcaatgggcggaagcctgacccagcgacgccgcgtgagggaagacagccttcgggttgtaaacctctgttgcaggggaagaaggaagtgacggtaccctgcgaggaagctccggctaact

SEQ ID NO: 4782 - DNA, 490 bp, Unknown
  Ascusbbf_1248726, encodes 16S rRNA
agagtttgatcctggctcaggacgaacgctggcggcgtgcctaacacatgcaagtcgaacgagaatcaatgggtagaggcttcggccaattgaagttgaggacggtggcggacgggtgagtaacacgtgagcaacctgcctttcagagggggacaacagttggaaacgactgctaataccgcataacgtatattgagggcatcctcgatataccaaagattttatcgctgaaagatgggctcgcgtctgattagctagttggtggggtaatggcctaccaaggcgacgatcagtagccggactgagaggttgaacggccacattgggactgagatacggcccagactcctacgggaggcagcagtggggaatattgggcaatgggggcaaccctgacccagcaacgccgcgtgaaggaagaaggtcttcggattgtaaacttcttttgtcagggacgatagtgacggtacctgacgaataagccacggct

SEQ ID NO: 4783 - DNA, 490 bp, Unknown
  Ascusbbf_1678695, encodes 16S rRNA
agatttgatcatggctcaggacgaacactggcggcgtgcttaacacatgcaagtcgaacggggcgaagagaagcttgcttttcctagcctagtggcaaacgggtgagtaacgcgtaggcaacctgcccttcagatggggacaacatttcgaaaggaatgctaataccgaatgacgtatcctggtcgcatgacctagataccaaaggccgggcaaccggtcactgaaggatgggcctgcgtctgattagctagttggtggggtaacggcctaccaaggcgacgatcagtagccggactgagaggttgaacggccacattgggactgagatacggcccagactcctacgggaggcagcagtcgggaatattgcgcaatggaggaaactctgacgcagtgacgccgcgtataggaagaaggttttcggattgtaaactattgtcgtgagggaagaaattgacagtacctcaggaggaagctccggctaactac

SEQ ID NO: 4784 - DNA, 490 bp, Unknown
  Ascusbbf_633303, encodes 16S rRNA
agagtttgatcatggctcaggatgaacgctggcggcgtgcttaacacatgcaagtcgagcgagaaatattcaaacgattcttcggatgaaattgaatatggacagcggcggacgggtgagtaacgcgtgggaaacctgccttatacaaagggatagcctcgggaaaccgggattaataccttatgacacttcactaccgcatggtagagaagtcaaaactccggtggtataagatggtcccgcgtcccattagctagttggtgagataaaagctcaccaaggcgacgatgggtagccggccttagcgggtgaacggccacactggaactgagacacggtccagactcctacgggaggcagcagtggggaatattgcacaatggaggaaactctgatgcagcgacgccgcgtgagtgatgaaggccctagggttgtaaagctctttcggcggggacgataatgacggtacccgcagaagaagccccggcta

SEQ ID NO: 4785 - DNA, 490 bp, Unknown
  Ascusbbf_905937, encodes 16S rRNA
agagtttgatcctggctcagaacgaacgctggcggcaggcttaacacatgcaagttgagcgggaactgagggtagcttgctacttgaggggagagcagcgtactggtgagtaacacgtgggaacataccttttggtgggggacaacagttggaaacgactgctaataccgcataagccctaagggggaaagattaattgccgaaagattggcccgcggaagattaggtagtaggtggggtaacggcccaccaaggcgacgatcagtaggggttctgagaggaaggtcccccacattgggactgagatacggcccagactcctacgggaggcagcagtcgggaatattgcgcaatggaggaaactctgacgcagtgacgccgcgtgcaggaagaaggttttcggatcgtaaagctctgttattggggaagaagaagtgacggtacccaatgaggaagtcccggctaattacgtgccagcagccgcggtaat

SEQ ID NO: 4786 - DNA, 490 bp, Unknown
  Ascusbbf_1171616, encodes 16S rRNA
agagtttgatcatggctcaggacgaacgctggcggcgtgcttcatacatgcaagtcgaacgataaggtctcttcggagacacataagtggcggacgggtgagtaatgtgtagagaatctgccctagagtgggggacaacagttggaaacgactgctaataccgcatatgcgcgtagctgagatgctattcgtgaaaactccggtgctctgggatgagtctgcatctgattagctagttgggggtgtaatggctcacctaggcgacgatccctagctggtctgagaggatgaccagccacactggaactgagacacggtccagactcctacgggaggcagcagtggggaatattgcacaatgggcgcaagcctgatgcagccatgccgcgtgtatgaagaaggccttcgggttgtaaagtactttcagcgaggaggaaggcgttaaggttaataaccttggcgattgacgttactcgcagaagaagcacag

SEQ ID NO: 4787 - DNA, 490 bp, Unknown
  Ascusbbf_1429182, encodes 16S rRNA
agagtttgatcatggctcagaatgaacgttggcggcgtggattaggcatgcaagtcgagcgagaacccgcaagggggacagcggcaaacggggtagtaatgtgtcggaacgtgcccagaggacggggatagcggcgggaaactgccggtaatacccgatgatctcgagagagcaaaggtgtgattccgcctttggagcggccgacatggtattagctagttggcggggtaacggcccaccaaggctttgatgcctaggggatgtgagagcatgatccccaccattgggactgagacactgcccagacacctacgggtggctgcagtcgagaatcttcgtcaatgggcgaaagcctgaacgagcgacgccgcgtgtgggatgaaggcccttgggttgtaaaccactgtcgagggggatgaaggcttgaaggtactccttcaagtttgacagagccctggaggaagcacgggctaagttcgtgccagcagcc

SEQ ID NO: 4788 - DNA, 490 bp, Unknown
  Ascusbbf_1430090, encodes 16S rRNA
agagtttgatcctggctcagattgaacgctggcggaatgctttacacatgcaagtcgagcggcagcgcggggcaacctggcggcgagcggcgaacgggtgagtaatacatcggaacgtgcccagacgtgggggataactactcgaaagagtggctaataccgcatacgatctgaggatgaaagcgggggatcgcaagacctcgcgcgtctggagcggccgatggcagattaggtagttggtgaggtaaaggcttaccaagcctgcgatctgtagctggtctgagaggatgatcagccacactgggactgagacacggcccagactcctacgggaggcagcagtggggaattttggacaatgggcgaaagcctgatccagccattccgcgtgcaggatgaaggccctcgggttgtaaactgcttttgtacggaacgaaaaagctccggctaatacctggagtccatgacggtaccgtaagaataagcaccg

SEQ ID NO: 4789 - DNA, 490 bp, Unknown
  Ascusbbf_917230, encodes 16S rRNA
agagtttgatcctggctcagaacgaacgctggcggcatgcctaacacatgcaagtcgaacgagaccttcgggtctagtggcgcacgggtgcgtaacacgtgggaacctgcccttaggttcggaataactcaccgaaaggtgtgctaataccggataatgtcttcggaccaaagatttatcgcctttggatgggcccgcgtaggattagctagttggtgaggtaatggctcaccaaggcgacgatccttagctggtcttagaggatgatcagccacactgggactgagacacggcccagactcctacgggaggcagcagtagggagttttcggcaatgggcgaaagcctgaccgagcaacgccgcgtgagtgagaaggtcttcggattgtaaagctctgttacgagggacgaacggtggggtcaggaaatgggccccaattgacggtacctcgccagaaagtgacggctaactacgtgccagcagccgcgg

SEQ ID NO: 4790 - DNA, 490 bp, Unknown
  Ascusbbf_1355149, encodes 16S rRNA
agagtttgatcctggctcaggatgaacgctggcggcgtgcctaatacatgcaagtcgaacgagagtagcaatactctagtggcgaacgggtgagtaacacgtagataacctgccctaaagacgaggataacaccgggaaactggagctaaaactggataggacaatttgaggcatcttaaattgtttaaaggaccagcaatggtacactttaggaggggtctgcggcgcattagttagttggtagggtaatggcctaccaagacagtgatgcgtagccggactgagaggtcaaacggccacattgggactgagaacggcccaaactcctacgggaggcagcagaagggaattttcggcaatggggggaaccctgaccgagcaacgccgcgtgaatgacgaagttcttcggaatgtaaagttcttttattagtgaagaatggcagatggaaaaatctgaatgacggtaactaatgaataagccccggctaa

SEQ ID NO: 4791 - DNA, 490 bp, Unknown
  Ascusbbf_1016817, encodes 16S rRNA
agagtttgatcatggctcaggatgaacgctggcggcgtgcctcagacatgcaagtcgaacgattaagacttccttcgggaagtgtataaagtggcgcacgggtgagtaacacgtaagtaatctgccctcgagtggggaataacgttcggaaacgaacgctaataccgcataacgcagcggcaccgcaaggtgacagttgttaaaggagtaattcgcttgaggaggagcttgcggcagattagcttgttggtaaggtaacggcttaccaaggctacgatctgtatccggtctaagaggacggtcggacacactgacactgaataacgggtcagactcctacgggaggcagcagtcgggaattttgggcaatgggcgaaagcctgacccagcaacgccgcgtgaaggatgaagtatttcggtatgtaaacttcgaaagaataggaagaataaatgacggtactatttataagctccggctaactacgtgcca

SEQ ID NO: 4792 - DNA, 470 bp, Unknown
  Ascusbbf_974811, encodes 16S rRNA
agagtttgatcctggctcagaacgaacgctggcggcaggcttaacacatgcaagtcgaacgatgtagcaatacatagtggcgcacgggtgagtaacgcgtgggaatgtaccttttggtggggaataactccgggaaactggagctaataccgcatacgcccttcgggggaaagatttatcgccaaaagatcagcccgcgtgagattaggtagttggtggggtaatggcctaccaagcctacgatctctagctggtcttagaggatgaccagccacactggaactgagacacggtccagactcctacgggaggcagcagtggggaatattggacaatgggcgaaagcctgatccagccatgccgcgtgagtgatgaaggctctagggttgtaaagctctttcgccgatgaagataatgacggtagtcggagaagaagccccggctaacttcgtgccagcagccgcggtaat

SEQ ID NO: 4793 - DNA, 206 bp, Unknown
  Ascusbbf_964744, encodes 16S rRNA
agagtttgatcctggctcagcagccgcggtaatgccagcagccgcggtaatctgtctcttatacacagagtttgatcatggctcagccagcagccgcggtaatagagtttgatcatggctcagcagccgcggtaatgccagcagccgcggtaatctgtctcttatacacagagtttgatcatggctcagccagcagccgcggtaat

SEQ ID NO: 4794 - DNA, 488 bp, Unknown
  Ascusbbf_558401, encodes 16S rRNA
agagtttgatcctggctcagggctaacgctggcggcgcgcctaacacatgcaagtcgaacgggcacttcggtgctagtggcagacgggtgagtaacgcgtggataatgtgcctctttgctggggataccgtttcgaaaggaacgttaataccgaatgtgctgaatttgtggcatcacagattgagtaaactgttagggtgaagagagcggtccgcgttctatcagcttgttggtggggtaatggcctaccaaggctacgacggataactggtctgagaggatgatcagtcacactggaactgagacacggtccagactcctacgggaggcagcagtgaggaatcttgcacaatgggcgaaagcctgatgcagcgacgccgcgtgagggacgaaggccttcgggttgtaaacctctgtcagtggggaagaagaatgacggtacccactgaggaagcttcggctaactacgtgccagcagccgcggtaat

SEQ ID NO: 4795 - DNA, 490 bp, Unknown
  Ascusbbf_906955, encodes 16S rRNA
agagtttgatcctggctcaggacgaacgctggcggcgtgcctaacacatgcaagtcgaacggaaaattgagcttcggttcaatttttagtggcgaacgggtgagtaacgcgtaggcaacctgccctttagacggggacaacattccgaaagggatgctaataccggatgtgacgctcctatcgcatgacgggagcgtgaaagatggcctctacacgtaagctatcgctaaaggatgggcctgcgtctgattagctagttggtagtgtaacggacaaccaaggcgatgatcagtagccggtctgagaggatgaacggccacattgggactgagacacggcccaaactcctacgggaggcagcagtggggaatattgcacaatgggggaaaccctgatgcagcgatgccgcgtgaaggaagaagtatctcggtatgtaaacttctatcagcagggaagaaaatgacggtacctgactaagaagccccggcta

SEQ ID NO: 4796 - DNA, 490 bp, Unknown
  Ascusbbf_1372541, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgacattagctagttggtaagttaccggcttacaaaggcgacgatgtctaggggatctgagaggcttatcaccagaactggtccttggcaacggaccagactcctacggtaggcagcagtgaggaatattggtcaatggacggaagtctgaaccagccatgccgcgtggaggaagaaggtcctatgggttgtaaactccttttgttcgagagtaataagggctttgcgaagcccgatgagagtatcggacgaataagc

SEQ ID NO: 4797 - DNA, 490 bp, Unknown
  Ascusbbf_936257, encodes 16S rRNA
agagtttgatcttggctcaggacgaacgctggcggcgtgcctaacacatgcaagtcgagcgagaatttctgaaatgaattcttcggaaggaattttgggaaggaaagcggcggacgggtgagtaacgcgtgagtaacctgcctatcagagggggacaacatttcgaaaggaatgctaataccgcatgaaattgtattatcgcatgatagaacaatcaaagatttatcgctgatagatggactcgcgtctgattagatagttggtggggtaaagacctaccaagtcgacgatcagtagccgaactgagaggttgatcggccacattgggactgagacacggcccagactcctacgggaggcagcagtggggaatattgcgcaatgggggcaaccctgacgcagcaacgccgcgtgaaggatgaaggttttcggattgtaaacttctgatctaagggaaaaagagagtgatggtaccttaggagcaagctac

SEQ ID NO: 4798 - DNA, 210 bp, Unknown
  Ascusbbf_658728, encodes 16S rRNA
agagtttgatcatggctcaggcagagctggcaaaacgcggtctgaatgaaactgaagtccgcgcacgccttgtccagaacggcattgacgtagataatctgaagccttcagactacgcatcttaccaggcaagaatcatgcagattctggatcagatgcaggcagaaaaagctggcactgcagcaaccacaggccagcagccgcggtaat

SEQ ID NO: 4799 - DNA, 490 bp, Unknown
  Ascusbbf_1701138, encodes 16S rRNA
agagtttgatcctggctcaggacgaacgctggcggcgtgcctaacacatgcaagtcgagcggaggcatacaaggagcaatctgcgtatgtttcagcggcggacgggtgagtaacgcgtgggcaacctgcctttcactgggggataacgcggcgaaagccgcactaataccgcataagaccccgagggccgcatggcctgggggtcaaaggagcaatccggtggaagatgggcccgcgtccgattaggtagttggtggggtaaaggcctaccaagcctgagatcggtagccgacctgagagggtgatcggccacactggaactgagacacggtccaaactcctacgggaggcagcagtgaggaatattggtcaatgggcgagagcctgaaccagccaagtagcgtgcgggacgaaggccctatgggttgtaaaccgcttttacggggggataaagtgagtgacgtgtcattcattgcaggtaccccgcgaa

SEQ ID NO: 4800 - DNA, 490 bp, Unknown
  Ascusbbf_1244224, encodes 16S rRNA
agagtttgatcctggctcagaacgaacgctggcggcgtgcctaacacatgcaagtcgaacgagaaagtccttcgggatgagtatagtggcgcacgggtgagtaatacataggaacgtacctctaggtggggaataaccaagggaagccttggctaataccgcatgatatcgcaagatcaaaggtggcctctacctgtaagctaccgccaagagatcggcctatgtcccattagctagttggcgaggtaatagctcaccaaggcgacgatgggtagctggtctgagaggacgatcagccacactggaactgagacacggtccagactcctacgggaggcagcagtgaggaatattggtcaatgggcgagagcctgaaccagccaagtagcgtgcaggaagacggccctatgggttgtaaactgcttttataggggaataaagtgagccacgtgtggttttttgcatgtaccctatgaataaggaccggcta

SEQ ID NO: 4801 - DNA, 490 bp, Unknown
  Ascusbbf_1243638, encodes 16S rRNA
agagtttgatcctggctcaggatggacgctggcggcgtgcctaacacatgcaagtcgaacgaggctcttccgactgatgattcgtctgaagacggaagatcaccgagtggcggatgggtgagtaacgcgtggagaacctgcccttatcagggggataacaactggaaacggttgacaataccgcataaagcaactgaccgcatgatcggttgcgaaaagatttatcggataaggatggctccgcgtcggattagctagttggtgaggtaacggcccaccaaggcgacgatccgtagccggcctgagagggcgaccggccacattgggactgagacacggcccagactcctacgggaggcagcagtggggaatattgcacaatgggcgcaagcctgatgcagcgacgccgcgtgagtgaagaagtatttcggtatgtaaagctctatcagcagggaagaaaatgacggtacctgcacaagaagccccggct

SEQ ID NO: 4802 - DNA, 490 bp, Unknown
  Ascusbbf_1679985, encodes 16S rRNA
agagtttgatcctggctcaggacgaacgctggcggcgtgcttaacacatgcaagtcgagcggaaaggccctttcgggggtactcgagcggcgaacgggtgagtaacacgtgagtaatctgcccttcacttcgggataactaccggaaacggtggctaataccggatatgaccacgtctcgcatggggtgtggtggaaagcgtttagcggtgggggatgtgctcacggcctatcagcttgttggtgaggtagtggctcaccaaggcttcgacgggtagccggcctgagagggtgaccggccacactgggactgagacacggcccagactcctacgggaggcagcagtggggaatattggacaatgggcggaagcctgatccagcaacgccgcgtgagggatgacggccttcgggttgtaaacctctttcacctatgacgaagcgagagtgacggtagtaggagaagaagcaccggccaactacgtgccagc

SEQ ID NO: 4803 - DNA, 490 bp, Unknown
  Ascusbbf_1528671, encodes 16S rRNA
agagtttgatcctggctcaggatgaacgctggcggcatgcctaagacatgcaagtcgtacgaggaggcccattgaaatggagtgattgcacaaagtggatttggattccctcctagtggcggaagggtgagaaatacgtaggttatttgcctcagagactgggataacatgcagaaatgcttgctaataccggatgataaatagaatggtacgttgttctattttaaaaggtgcctctaaagcaccactttgagagaagcctgcggcgtattagctagttggtgaggtaatggcccaccaaggcttcgatgcgtagccgacctgagagggtgatcggccacactgggactgagacacggcccagactcctacgggagacagcagttaggaatattcgtcaatgggggcaaccctgaacgagcaacgccgcgtgaaggaagaaggtcttcggattgtaaacttcttttatgagggacgaaggacgtgacgg

SEQ ID NO: 4804 - DNA, 490 bp, Unknown
  Ascusbbf_1542833, encodes 16S rRNA
agagtttgatcctggctcagaacgaacgctgatggcgtgcctcatacatgcaagtcgagcgccccgcaaggggagcggcgaacgggtgagtaacgcgtgaacaatctgcctcaaagtgggggataaccattccaacggatggctaataccgcatagggtttggaagtggcatcacttctttacgaaagcatttatgcgctttgagatgagttcgcgtcccattagctagttggcggggtaacggcccaccaaggcaacgatgggtagccggcctgagagggtgtccggccacattgggactgagatacggcccagactcctacgggaggcagcagtagggaattttgcgcaatgggggaaaccctgacgcagcaacgccatgtgtgggatgaagcatttcggtgtgtaaaccactgtcggcagggaataaagcccacgtttacgtgggggtgaatgtacctgcagaggaagccccggctaacttcgtgcc

SEQ ID NO: 4805 - DNA, 490 bp, Unknown
  Ascusbbf_1372268, encodes 16S rRNA
agagtttgatcctggctcaggacgaacgctggcggcatgcttcatacatgcaagtcgaacgataaggtctcttcggaggtacataagtggcggacgggtgagtaatatgtaggtaatctgccctagagagggggacaacagagggaaacttctgctaatacctcatatgagcgtacctgaaatggtattcttgaaaactccggtgccctctggggagccaacatctgattagctagttggcgggttaatggaccaccaagtcgacgatcagtagctggtttgagagtttgatcagccacaatgggacggggagacggcccaggctataccggaagacagcagaaaggaattttgcgcaatgggggatggcctaaggcagccatgccgcgggaacgtagaagcccatcggagtgtgacgttgtataagtagaggcgaattttgacggtacctacagaggaagcaccggctaactccgtgccagcagccgcg

SEQ ID NO: 4806 - DNA, 490 bp, Unknown
  Ascusbbf_1436436, encodes 16S rRNA
agagtttgatcctggctcaggatgaacgccggcggcgtgcttaacacatgcaagtcgaacgaggtataagaacggaagttttcggacggaagatcttgtactgagtggcggacgggtgagtaacgcgtgggaaacctgccctgttccgggggataccagttggaaacgactgttaataccgcataagcgcacagcaccgcatggtgcagtgtgaaaaactccggtggaacaggatggtcccgcgtctgattaggcagttggcagggtaactgcctaccaaaccgacgatcagtagccggcctgggaaggggaacggcgaccttacgacggcgacacggaccaaactcctacgggaggcagcagtggggaatattgcacaataggggtaaccctgatgcggcgacgccgcgtgagggaagaagtatttcggtatggaaagctctatcagcagggaagaagatgacggtacctgcagaagcagccccggcta

SEQ ID NO: 4807 - DNA, 470 bp, Unknown
  Ascusbbf_1661871, encodes 16S rRNA
agagtttgatcatggctcagaacgaacgctggcggcaggcttaacacatgcaagtcgaacgccccgcaaggggagtggcagacgggtgagtaacgcgtgggaatctacccagttctacggaacaacacagggaaacttgtgctaataccgtatacgccctacgggggaaagatttatcggaattggatgagcccgcgttggattagctagttggtgaggtaaaggctcaccaaggcgacgatccatagctggtctgagaggatgatcagccacacggggactgagacacggccccgactcctacgggaggcagcagctaagaatcttgcgcaatgggcgaaagcctgacgcagcaacgccgcgtgggggaggaaggccttcgggttgtaaaccccttttgtgagggaagaaattttgacggtacctcacgaataagccacggctaactacgtgccagcagccgcggtaat

SEQ ID NO: 4808 - DNA, 490 bp, Unknown
  Ascusbbf_898363, encodes 16S rRNA
agagtttgatcctggctcagaacgaacgctggcggcaggcttaacacatgcaagtcgagcgatcccttcggggatagcggcggacgggtgagtaacgcgtgggaacgtgcccttttcttcggaatagcccagggaaacttggattaataccggatacgcccttcgggggaaagatttatcgggaaaggatcggcccgcgttggattagatagtaggcggggtaacggcccacctagtcgacgatcagtaggggttctgagaggaaggtcccccacattggaactgagacacggtccaaactcctacgggaggcagcagtgaggaatattggtcaatggacgagagtctgaaccagccaagtagcgtgaaggaagactgccctatgggttgtaaacttcttttgtttgggaataaagtgggccacgtgtggccttttgtatgtaccatacgaataagcatcggctaattccgtgccagcagccgcggtaat

SEQ ID NO: 4809 - DNA, 490 bp, Unknown
  Ascusbbf_822223, encodes 16S rRNA
agagtttgatcatggctcaggatgaacgctagcggcaggcctaatacatgcaagtcgaacgggatccatgagtagcttgctacttatggtgagagtggcgcacgggtgcgtaacgcgtgagcaacctacccatatcagggggatagcccggagaaatccggattaataccgcatgcaaccattttgtggcatcataagatggttaaatatttataggatatggatgggctcgcgtgacattagctagttggtgaggtaacggctcaccaaggcaacgatgtctagggtctctgagaggagaatcccccacactggtactgagacacggaccagactcctacgggaggcagcagtaaggaatattggtcaatggagggaactctgaaccagccatgccgcgtgcaggatgactgccctatgggttgtaaactgcttttatcagggaataaatgttagtacgtgtactaatttgaatgtacctgaagaataa

SEQ ID NO: 4810 - DNA, 490 bp, Unknown
  Ascusbbf_990186, encodes 16S rRNA
agagttgatcatggctcaggatgaatgctggcggcgtgcctaatacatgcaagtcgagcggtaacagggcttcaccgtgttcttgacgcacttggccatagagcaagtagctgatttcgaggacacagtgaagctgctgacgagcggcggacggctgagtaacgcgtgggaacggaccccaaactgagggataactagtcgaaagattagctaataccgcatgtgatcttcggattaaaggatttatccggtttgggactggcctgcgtacgattagatagttggtagggtaatggcctaccaagtcaacgatcgttagatggtttgagaagatgatcatccagactgggactgagacacggcccagactcctacgggaggcagcagtagggaatctttcacaatgggcgaaagcctgatggagcaacgccgcgtgcaggatgacggccttcgggttgtaaactgcttttataagcgagaaatatgatgg

SEQ ID NO: 4811 - DNA, 349 bp, Unknown
  Ascusbbf_600956, encodes 16S rRNA
agagtttgatcatggctcaggatgaacgctggcggcgtgcttaacacatgcaagtaggtgatataagatggacccgcgttggattagtcagttggcagggtaacggcctaccaaagcgacgatccatagccggcctgagagggtgaacggccacattgggactgagacacggcccagactcctacgggaggcagcagtggggaatattgcacaatgggggaaaccctgatgcagcgacgccgcgtgaaggaagaagtatctcggtatgtaaacttctatcagcagggaagaaaatgacggtacctgactaagaagccccggctaactacgtgccagcagccgcggtaat

SEQ ID NO: 4812 - DNA, 480 bp, Unknown
  Ascusbbf_1373642, encodes 16S rRNA
agagtttgatcctggctcagaacgaacgctggcggcaggcctaacacatgcaagtcgaacgtgaagcatccttcgggatgtggaaagtggcagacgggtgagtaacgcgtgggaatttacctaatggtacgggatagctcagggaaacttggatcaataccgtataagccctccgggggaaagatttatcgccattagagaagcccgcgttagattagcttgttggtgaggtaacggctcaccaaggcgacgatctatagctggtctgagaggatgatcagccacactgggactgagacacggcccagactcctacgggaggcagcagtggggaatattgcacaatgggcgaaagcctgatgcagccatgccgcgtgagtgacgaaggccttagggttgtaaagctctttcaccggtgaagataatgacggtagccggagaagaagccccggctaactccgtgccagcagccgcggtaat

SEQ ID NO: 4813 - DNA, 490 bp, Unknown
  Ascusbbf_467461, encodes 16S rRNA
agagtttgatcatggctcaggatgaacgctagctacaggcttaacacatgcaagtcgaggggcagcatgaaagtagcttgctacttttgatggcgaccggcgcacgggtgcgtaacgcgtatccaactttcccgttactctcggatagccttccgaaagggagattaatacgagatggtgtctttatttcgcatgttatgaagactaaagatttattggtaacggatagggatgcgtgacattagatagttggcggggtaacggcccaccaagtccacgatgtctaggggttctgagaggaaggtcccccacactggaactgagacacggtccagactcctacgggaggcagcagtgaggaatattggtcaatggccgagaggctgaaccagccaagtagcgtgaaggatgaaggttctatggattgtaaacttcttttatacgggaataacatcacctacgtgtaggtgcctgcatgtaccgtatgaat

SEQ ID NO: 4814 - DNA, 488 bp, Unknown
  Ascusbbf_1347039, encodes 16S rRNA
agagtttgatcctggctcaggacgaacgctggcggcgtgcttaacacatgcaagttgagcgggaatagttgatagcttgctattgactatgagagcagcgcactggtgagtaacacgtgggaacataccttttggtgggggacaacagagggaaacttctgctaataccgcataagccctaagggggaaagattaattgccgaacgattggcccgcggaagattaggtagtaggtggggtaacggcctacctagccgacgatctatagctggtctgagaggacgaacagccacattggaactgagacacggtccagactcctacggggggcagcaggggggaatattgggcagtggaggcaactctgacacagccatgccgcgtgagtgaagaaggttttcggagtgtaaagctctttcagacgggaagatgatgacggtaccgtcagaagaagcaccggctaacttcgtgccagcagccgcggtaat

SEQ ID NO: 4815 - DNA, 472 bp, Unknown
  Ascusbbf_1440192, encodes 16S rRNA
agagtttgatcctggctcaggatgaacgctagctacaggcttaacacatgcaagtcgaacgcatgccttttggcatgagtggcgcacgggtgagtaccgcgtgggaaccgaccctggggttggggataaccgctggaaacggcggctaatacccgatacgccttacgagggaaagatttattgcccttggacgggcccgcgttggattaggtagttggtggggtaacggcctaccaagcctgcgatccatagctggtttgagaggatgatcagccacactgggactgagacacggcccagactcctacgggaggcagcagtggggaatattggacaatgggggcaaccctgatccagccatgccgcgtgagtgaagaaggccttagggttgtaaagctctttcagtggtgaagatgatgacggtagccacagaagaagccccggctaactccgtgccagcagccgcggtaat

SEQ ID NO: 4816 - DNA, 490 bp, Unknown
  Ascusbbf_1655099, encodes 16S rRNA
agagtttgatcctggctcaggatgaacgctggcggcgtgcctaatacatgcaagtcgaacggagcaccttggtgctaagtggcgaacgggtgaggagaacataggtaacctgcccctccgagggggacaacagctggaaacggctgctaagaccgcatagacgcattcagggcatcctggatgcgctaaatgaccggatggtcagcggggggatggacctatgcagtattagctagttggcggggcaacggcccaccaaggcgacgatacttagccggcctgagagggcggacggccacactgggactgagacacggcccagactcctacgggaggcagcagctaaggatcttccgcaatgggcgaaagcctgacggagcgacgccgcgtgagtgaggaagtatttcggtatgtaaagctctatcagcagggaagaaaatgacggtacctgactaagaagccccggctaactacgtgccagcagccgcgg

SEQ ID NO: 4817 - DNA, 469 bp, Unknown
  Ascusbbf_1705376, encodes 16S rRNA
agagtttgatcatggctcagattgaacgctggcggcaggcctaacacatgcaagtcgaacgaagtcttcggacttagtggcgcacgggtgagtaacacgtgggaacatacctttcggtgggggataacatcgggaactgatgctaataccgcatacgccccttgggggaaagatttatcgccgaaagattggcccgcgtccgattagctagttggtgaggtaacggctcaccaaggctccgatcggtagctggtctgagaggatgaccagccacactgggactgagacacggcccagactcctacgggaggcagcagtggggaatattggacaatgggcgcaagcctgatccagccatgccgcgtgagtgatgaaggccttagggttgtaaagctctttcacccacgacgatgatgacggtagtgggagaagaagccccggctaacttcgtgccagcagccgcggtaat

SEQ ID NO: 4818 - DNA, 468 bp, Unknown
  Ascusbbf_1444829, encodes 16S rRNA
agagtttgatcctggctcagaacgaacgctggcagcaggcttaacacatgcaagtcgagcgcgtagcaatacgagcggcagacgggtgagtaacgcgtgggaatctaccccttactacggaataacgcagggaaacttgtgctaataccgtatgtggccgagaggcgaaagatttatcggtaagggatgagcccgcgttggattagctagttggtggggtaaaggcctaccaaggcgacgatccatagcaggcctgagaggatgatcagccacactgggactgagacacggcccagactcctacgggaggcagcagtggggaatattggacaatgggcgcaagcctgatccagccataccgcgtgagtgatgaaggccctagggttgtaaagctctttcaccggtgaagataatgacggtaaccggagaagaagccccggctaacttcgtgccagcagccgcggtaat

SEQ ID NO: 4819 - DNA, 490 bp, Unknown
  Ascusbbf_1666566, encodes 16S rRNA
agagtttgatcctggctcaggacgaacgctggcggcgtgcctaacacatgcaagtcgaacgagaagtcttttaatgattccttcggggagatttaaaagatggacagtggcggacgggcgagtaacgcgtgagtaacctgcccataagtgagggatagcccatggaaacgtggagtaatacctcatattgtatactggtcacatgacctatatatgaaagatttatcgcttatggatggactcgcgtctgattagatagttggtgaggtaacggctcaccaagtcgacgatcagtagccgaactgagaggttgatcggccgcattgggactgagacacggcccagactcctacgggaggcagcagtggggaatattgcgcaatgggggaaaccctgacgcagcaacgccgcgtgcaggaagaaggtcttcggattgtaaactgttgtcgcaagggaagaagacagtgacggtaccttgtgagaaagtcac

SEQ ID NO: 4820 - DNA, 490 bp, Unknown
  Ascusbbf_1111366, encodes 16S rRNA
agagtttgatcctggctcaggacgaacgctggcggcgggcttaacacatgcaagtcgaaggagaaggaaggcgcttgcgccttctggagactggcggacgggtgagtaacgcgtagataacctgcctatacctgggggataacatctcgaaagaggtgctaataccgcataatgcagcggggccgcatggccacagttgttaaaggtttcggccgggtatagaggggtctgcgtgctattagttagttggtgaggtaacggctcaccaaggcgatgatagctagggggtctgagaggatgatcccccacactgggactgagacacggcccagactcctacgggaggcagcagtgaggaatattggtcaatgggcgagagcctgaaccagccaagtagcgtgcaggatgacggccctatgggttgtaaactgcttttgtatggggataaagtgctccacgtgtggagttttgtaggtaccatacgaataag

SEQ ID NO: 4821 - DNA, 490 bp, Unknown
  Ascusbbf_1778973, encodes 16S rRNA
agagtttgatcatggctcaggacgaacgctggcggcgtgcttaacacatgcaagtcgaacgctgaagcatcttcgggtgtggatgagtggcgaacgggtgagtaacacgtgggtaatctgccctgcactctgggataagccttggaaacggggtctaataccggatacgacacatggaggcatcttcgtgtgtggaaagctccggcggggggggatgggcccgcggcctgttagctagttggcggggcaacggcccaccaaggcgactatgggtagctgggttgagagaccgaccagccagattgggactgagacacggcccagactcctacgggaggcagcagtggggaatcttgcgcaatgggcggaagcctgacgcagcgacgccgcgtgcgggaggaaggccctcgggtcgtaaaccgctttcagcagggacgaggccgcaaggtgacggtacctgcagaagaagccccggctaactacgtgccag

SEQ ID NO: 4822 - DNA, 490 bp, Unknown
  Ascusbbf_1293041, encodes 16S rRNA
agagtttgatcctggctcaggacgaacgctggcggcgggcttaacacatgcaagtcgaacgctccctttggggagagtggcgcacgggtgagtaacgcgtaggcaatctacccccagctggggaataacccatcgaaagatgggctaataccgcataacgtcggatggtcgcatggccgaccgaccaaagttcaggcggctggggatgagcctgcgttggattagcttgttggtagggtaacggcctaccaaggcgacgatccatagcgggtctgagaggatgatccgccacactggcactgggacacgggccagactcctacgggaggcagcagtgaggaatattgcgcaatggacgaaagtctgacgcagccacgccgcgtgcaggaagacacccctctggggcgtaaactgcttttgtgtgagaagaacaccccgttctgcggggtctgacggtatcgcacgaataaggaccggctaactccgtgcc

SEQ ID NO: 4823 - DNA, 490 bp, Unknown
  Ascusbbf_1900212, encodes 16S rRNA
agagtttgatcatggctcaggatgaacgctggcggcgtgcctaacacatgcaagtcgaacggggcccgtggcgctcccctttggggaggggcaggggctgagtggcggacgggtgagtaacgcgtgggtaacctgccctgtacagggggataacagccggaaacggctgctaataccgcataagcgcggggggcggcatcgctccccgcggaaaactccggtggaacaggatggtcccgcgtctgattaggcagttggcagggtaacggcctaccgaaccgacgatcagtagccggcctgagagggtgaacggccacattgggactgagacacggcccaaactcctacgggaggcagcagtggggaatattgcacaatggggggaaccctgatgcagcgacgccgcgtgagtgaagaagtatttcggtatgtaaagctctatcagcagggaagaagatgacggtacctgcagaagcagccccggctaact

SEQ ID NO: 4824 - DNA, 490 bp, Unknown
  Ascusbbf_1371514, encodes 16S rRNA
agagtttgatcatggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacggtgtgtaatactccataacatatggattcacatggatttatattgaaagattcgttggtgacggatgggctcgcgtaacattagctagtcggcggggtaacggcccaccgaggctacgatgtttaggggttctgagaggaaggtacaccacactggaacacagacacggtccagagtcgtaagggaggaagaagtgagtaatattggtcaatgggcggaagcctgaactagcaatgccgcgtgcaggaataaggccctatgggtagtaaactgcttgtccttgagggaaataagggtcacgtgtggcccgatgagagtatcaggggaataagca

SEQ ID NO: 4825 - DNA, 405 bp, Unknown
  Ascusbbf_580215, encodes 16S rRNA
agagtttgatcctggctcagggatagccttccgaaagaaagattaatacctgatggtctcgtgtcgggacatcccgttgcgagtaaagattcatcggcgatggatggggatgcgtccgattagcttgtaggcggggtgacggcccaccaaggcgacgatcggtaggggctctgagaggagggtcccccacactggaactgagacacggtccagactcctacgggaggctgcagtgaggaatattggtcaatgggcgagagcctgaaccagccaagtggcgtgagggatgacggccctacgggttgtaaacctcttttgtttgggaataaagtgggccacgcgtggccttttgtatgtacctttcgaataagcatcggctaattccgtgccagcagccgcggtaat

SEQ ID NO: 4826 - DNA, 490 bp, Unknown
  Ascusbbf_1324449, encodes 16S rRNA
agagtttgatcctggctcaggatgaacgctagctacaggcttaacacatgcaagtcgaggggcagcgcggggtagcaatactttggcggcgaccggcgggagggtgcgtaacgcgtgagcaacttgcccgccactgggggataggcactggaaacggtgtgtaatactccataacatatggattcacatggattcatatggaaagattcgttggtgacggatgggctcgcgtaacattagctagtcgtcgtggtaacggcccaccgcagctacgctgtgtaggggttctgagaggaaggtcccccacattggaagtgagacacggtccagactcctacgggaggcagcagtgaggaatattggtcaatgggcggaagcctgaaccagccatgccgcgtgcaggaataaggccctatgggtcgtaaactgcttttccttgagggcaataaggatcacgtgtggttcgatgagagtatcaggggaataagca

SEQ ID NO: 4827 - DNA, 490 bp, Unknown
  Ascusbbf_1440672, encodes 16S rRNA
agagtttgatcatggctcaggatgaacgctggcggcgtgcttaacacatgcaagtcgaacggaccaaaaggagcttgctccttgcggttagtggcggatgggtgagtaacgcgtgggtaatctgccttatacaaagggataactcagagaaatctgtgctaaaaccttataagcttacacgatcatatgatcgagtaagaaaaactttagtggtataagatgagcccgcgtccgattagctagttggtgagataatggctcaccaaggcaacgatcggtagccggcctgagagggtgaacggccacactgggactgagacacggcccagactcctacgggaggcagcagtggggaatattgcacaatggggggaaccctgatgcagcaacgccgcgtgaaggatgaaggttttcggattgtaaactattgtctgcagggaagaataaagactgtacctgcaaagaaagctccggctaactacgtgccagc

SEQ ID NO: 4828 - DNA, 490 bp, Unknown
  Ascusbbf_1267999, encodes 16S rRNA
agagtttgatcatggctcaggatgagcgctgacggcgtgcctaacacatacaaatcaaacggaaaggattcttcggaattctttcagtgacggacggatgaataacgcatgggtaacctgccccatacagaggaacaacagctgaaaacggctgctaataccacataagcgcacaatgctgcatggtacagtgtaaaaaaattttatcggtatgggatggacccgcgtctgattagctagttggagaggtaacggcccaccaaggcgacaatcagtagccgacctgagagggtgaccggccacattggaactgagacacggcccaaactcctacaggaggcaacaataaaggatattgcacaatgggcgaaagcctgatgcagcgacgccgcgtgagtgaggaagtatttcggtatgtaaagctctatcagcagggaagaaaatgacggtacctgactaagaagccccggctaactacgtgccagcagcc

SEQ ID NO: 4829 - DNA, 490 bp, Unknown
  Ascusbbf_1324389, encodes 16S rRNA
agagtttgatcctggctcagattgaacgctagcggaatgctttacacatgcaagtcgaacggcagcgcaagagagcttgctctctggcggcgagtggcgaacgggtgagtaatgcatcggaacgtgcccagtagcgggggataactacgcgaaagcgtggctaataccgcatacgccctacgggggaaagggggggattcttcggaacctctcactattggagcggccgatgtcggattagctagttggtggggtaaaggcctaccaaggcgacgatccgtagctggtttgagaggacgacaggccacactggaacggagacacggccaagactcctacgggaggcagcagtggggaattttggacaatgggggcaaccctgatccagccatgccgcgtgtgtgatgaaggccttcgggttgtaaagcacttttggcagagaagaaatggtttgggttaataccctgaatcgatgacggtatctgcagaa

SEQ ID NO: 4830 - DNA, 490 bp, Unknown
  Ascusbbf_1410728, encodes 16S rRNA
agagtttgatcctggctcaggacgaacgctggcggcgtgcttaacacatgcaagtcgaacgctgaagcccacttcggtgggtggatgagtggcgaacgggtgagtaacacgtggacaatctgccctgcacttcgggataagccttggaaacgaggtctaataccgaataggacactgcatcgcatggtgtggtgtggaaagcgtttaatgcggtgtgggatgagtccgcggcctatcagcttgttggtggggtgatggcctaccaaggcgacgacgggtagccggcctgagagggtgaccggccacactgggactgagacacggcccggactcctacgggaggcagcagtggggaatattgcacaatgggggaaaccctgatgcagcgacgccgcgtgagtgaagaagtatttcggtatgtaaagctctatcagcaaggaagataatgacggtacttgactaagaagccccggctaactacgtgccagca

SEQ ID NO: 4831 - DNA, 490 bp, Unknown
  Ascusbbf_997233, encodes 16S rRNA
agagtttgatcctggctcaggatgaacgctagcgggaggcttaacacatgcaagccgagggatattgtgctttcgggcacaagagaccggcggacgggtgagtaacatgtatgcaacttgcctctatcagtgggataacccggggaaactcggactaataccgcataacaatattatcagcattgatgatatttaaaagatttatcggatagagataggcatgcgtaggattagttagttggtgaggtaaaggctcaccaagacgatgatccttagggggcctgagagggtgatcccccacactggtactgagacacggaccagactcctacgggaggcagcagtgaggaatattggacaatgggtgagagcctgatccagccatcccgcgtgcaggaagacggccctatgggttgtaaactgcttttatacaggaataaaccattttacgagtaggatgttgaaggtactgtatgaataagcatcggct

SEQ ID NO: 4832 - DNA, 490 bp, Unknown
  Ascusbbf_515327, encodes 16S rRNA
agagtttgatcatggctcaggacgaacgctggcggcgtgcctaatacatgcaagtcgagcggattgatgggagcttgctccctgatatcagcggcggacgggtgagtaacacgtgggcaacctgcctatacgactgggataacttcgggaaaccggagctaataccggataatccctttcctctcatgaggaaaggctgaaagatggcttttcgctatcacttatagatgggcccgcggcgcattagctagttggtgaggtaacggctcaccaaggcaacgatgcgtagccgacctgagagggtgatcggccacactgggactgagacacggcccagactcctacgggaggcagcagtagggaattttgcgcaatgggcgaaagcctgacgcagcaacgccgcgtgatcgtagaagcccttcggggtgtaaagatctgtcagtagggacgaacaatgactgtacctacagaggaagcaccggctaactcc

SEQ ID NO: 4833 - DNA, 490 bp, Unknown
  Ascusbbf_691089, encodes 16S rRNA
agagtttgatcctggctcaggataaacgctggcggcgtgcatgagacatgcaagccgaacgaaggatcgggcttgctcgatccttagtggcggacggctgagtaacgcgtaggtgacctaccccgaagtggggaataactgcccgaaagggtggctaataccgcatgtggtcgcacgttcattcgtgcgagtaaagccgcaaggcgcttcgggaggggcctgcgtccgattagctcgttggtggggtaatggcttaccaaggcgacgatcggtaggtggtctgagaggacgatcacccagactgggactgagacacggcccagactcctacgggaggcagcagtcgggaattttgctcaatgggggaaaccctgaagcagcaacgccgcgtgagggatgaaggccttcgggttgtaaacctcttttgtcagggacgatgatgacggtacctggcgaataagccacggctaactacgtgccagcagccgcg

SEQ ID NO: 4834 - DNA, 490 bp, Unknown
  Ascusbbf_1373002, encodes 16S rRNA
agagtttgatcctggctcaggatgaacgctagcggcaggcttaacacatgcaagtcgaggggtaacgcggggtagcaatactctggcgacgaccggcgcacgggcgcgtaacgcgtatgcaacctacctgtaacaggggtataacggagagaaatttccactaatcccccatattgttagagattcgcatgtttctctaacgaaagcttcgttggttacggttgggcaggcgtgacattagctagttggtaaggtaacgacttaccaaggcgacgatgactaggggagctgagtggcttatcccacgaatgggaacgggaaaacgtaccagcgtcctaggggaggaggaggggaggaaaatgggtcaatggacggagctcggaaccggccaggaggcgtggaggaagaagggcctatgggtggtaaactccttttgttcgagagtaataagaggcttgcgagcctagaggagagtatcggacgaataagc

SEQ ID NO: 4835 - DNA, 490 bp, Unknown
  Ascusbbf_1246230, encodes 16S rRNA
agagtttgatcctggctcaggacgaacgctggcggcgtgcttaacacatgcaagtcgagcggtaaggcccttcggggtacacgagcggcgaacgggtgagtaacacgtgagcaacctgcccctgactccgggataagcggtggaaacgccgtctaataccggatacgaccccccggatcatgccggagggtggaaagtttctcggttggggatgggctcgcggcctatcagcttgttggtggggtaaaggcctaccaaggcgattacgggtagccggcctgagagggtgaccggccacactgggactgagacacggcccagactcctgcgggaggcagcagtgaggaatattggtcaatgggcgtaagcctgaaccagccaagtagcgtgcaggatgacggccctatgggttgtaaactgcttttatgcggggataaagtcacctacgtgtaggtgtttgtaggtaccgcatgaataaggaccggctaat

SEQ ID NO: 4836 - DNA, 490 bp, Unknown
  Ascusbbf_1038556, encodes 16S rRNA
agagtttgatcctggctcaggatgaacgctggcggcgtgcttaacacatgcaagtcgaacgaggtacaaggacggaagccttcggacggaagatcttgtactgagtggcggacgggtgagtagcgcgtgggaaacctgccctgttccgggggataccagttggaaacgactgttaataccgcataagcgcacagcaccgcatggtgcagtgtgaaaaactccggtggaacaggatggtcccgcgtctgattaggcagttggggaggtaacggctcaccaaaccgatgatctctagctggtttgagaggacaatcagccacattggaattgggaaacggtccaaactcctacgggaggcagcagtggggaatattgcacaatgggggaaaccctgatgcagcgacgccgcgtgagtgaagaagtatttcggtatgtaaagctctatcagcagggaagaaaatgacggtacctgactaagaagccccggcta

SEQ ID NO: 4837 - DNA, 490 bp, Unknown
  Ascusbbf_1766882, encodes 16S rRNA
agagtttgatcatggctcaggatgaacgctggcggcgtgcttaacacatgcaagtcgaacgaagcacttaagattgactcttcggatgacgtcttttgtgacttagtggcggacgggtgagtaacgcgtgggtaacctgcctcacacagggggataacagttagaaatgactgctaataccgcataacccgataggatcgcatgatccagacggaaaagatttatcggtgtgagatggacccgcgtctggttagctagttggcggggcaacggcccaccaaggcgactatgggtagctgggttgagagaccgaccagccagattgggactgagacacggcccagactcctacgggaggcagcagtggggaatattgcacaatggaggaaactctgatgcagcgacgccgcgtgagcgatgaagtatttcggtatgtaaagctctatcagcagggaagataatgacggtacctgactaagaagcaccggct

SEQ ID NO: 4838 - DNA, 468 bp, Unknown
  Ascusbbf_1006942, encodes 16S rRNA
agagtttgatcctggctcagaacgaacgctggcggcaggcctaacacatgcaagtcgaacgatccttcgggatagtggcgcacgggtgcgtaacgcgtgggaatatgcccttgggtgcggaataacgtatggaaacgtacgctaataccgcataatgactccggtccaaagatttatcgcccaaggattagcccgcgttagattagctagttggtgaggtaatggctcaccaaggcgacgatctatagggggtctgagaggatgatcccccacactgggactgagacacggcccagactcctacgggaggcagcagtgaggaatattggacaatggaggaaactctgatccagccatgccgcgtgtatgaagaaggccttagggttgtaaagtactttcaaacgtgaagataatgacggtagcgttagaagaagctccggctaaattcgtgccagcagccgcggtaat

SEQ ID NO: 4839 - DNA, 488 bp, Unknown
  Ascusbbf_1445312, encodes 16S rRNA
agagtttgatcatggctcagaacgaacgctggcggcaggcttaacacatgcaagttgagcgggattaattgatagcttgctattaattatgagagcagcgcactggtgagtaacacgtgggaacataccttttggtgggggacaacagttggaaacgactgctaataccgcataagccctaatggggaaaggttaattgccgaacgattgacccgcggaagattaggtagtaggtgtggtaacgtcctacctagccgacgatctctagctggtctgagaggacaagcagccacatttgaactgcgacacggtccaggatcctacgggaggcagcagggaggaatattgggcaatggaggaaactctgacccagccatgccgcgtgagtgaagaaggttttcggattgtaaagctctttcagacgggaagatgatgacggtaccgtcagaagaagcaccggctaactccgtgccagcagccgcggtaat

SEQ ID NO: 4840 - DNA, 490 bp, Unknown
  Ascusbbf_1104086, encodes 16S rRNA
agagtttgatcctggctcagggtgaacgctagctacaggcttaacacatgcaagtcgaggggtaacgacagcgaaagcttgcttttgctgggcgacgaccggcgcacgggtgagtaacgcgtatccaacctgcccataactaagggataatccgtagaaatgcggtctaataccttatgtgttccgacgaggacatctgaattggaataaagatttatcggttatggatggggatgcgtctgattagattgttggcggggcaacggcccaccaaggcgatgatggatagccgggttgagagaccgaccggccagattgggactgagacacggcccagactcctacgggaggcagcagtggggaatcttgcacaatgggcgaaagcctgatgcagcgacgccgcgtgcgggaaggaggccctcgggtcgtaaagctctgttgtcggggacgaatgttgaggcctagaacataggtttcaaatgacggtacc

SEQ ID NO: 4841 - DNA, 479 bp, Unknown
  Ascusbbf_1334658, encodes 16S rRNA
agagtttgatcctggctcaggatgaacgctggcggcgtgcctaatacatgcaagtcgagcggtaaggccacttcggtggtacacgagcggcggacggctgagtaacacgtaggaacgtaccccaaactgagggataactgctcgaaagagtagctaataccgcatgtgatcttcggattaaagctacggcggtttgggaacggcctgcgcatgattagcttgttggtgaggtaatggctcaccaaggcgacaatcattagctggtctgagaggatgatcagccagactgagactgagaacggcccagactcctacgggaggcagcagtagggaattttccacaatgggcgaaagcctgatggagcaacgccgcgtgcaggatgaaggccttcgggttgtaaactgcttttatatgtgacgattatgacggtagcatatgaataaggatcggctaactccgtgccagcagccgcggtaat

SEQ ID NO: 4842 - DNA, 490 bp, Unknown
  Ascusbbf_1777811, encodes 16S rRNA
agagtttgatcatggctcaggatgaacgctagcggcaggcttaacacatgcaagtcgaggggcagcggggctgagtgcttgcactcggccgccggcgaccggcgcacgggtgagtagcacgtatgcaacctgccccggagcgggggataacccggcgaaagccggactaataccgcgtacatatctgaaaggcatctttcagataggaaaggacctcggtccgctccgggatgggcatgcggcgcattaggcagacggcggggtaacggcccaccgtaccgacgatgcgtaggggttctgagaggaaggccccccacactggtactgagacacggaccagactcctacgggaggcagcagtgaggaatattggtcaatgggcggaagcctgaaccagccatgccgcgtgcaggaatgaggccctacgggtcgtgaactgcttttcgcgcggagcaataaggggggttcgcccccccgatgagagtacgcg

SEQ ID NO: 4843 - DNA, 490 bp, Unknown
  Ascusbbf_1043569, encodes 16S rRNA
agagtttgatcatggctcaggacgaacgctggcggcgtgcttaacacatgcaagtcgaacgagacgatttagaagcttgcttttaaagagtcgagtggcaaacgggtgagtaacgcgtagacaacctgccgcaaagatggggacaacagtccgaaaggactgctaataccgaatgttgtatcttttccgcatggaaggggtattaaagatggcctctacttgtaagctatcgcctgaagaggggtttgcgtctgattaggcagttggtgaggtaacggcccaccaaacctacgatcagtagccggtctgagaggatggacggccatactggaactgagacacggcccagactcctacgggaggcagcagtggggaatcttccgcaatgggcgaaagcctgacggagcaacgccgcgtgaaggatgaaggttttcggattgtaaacttcttttattaaggacgaataatgacggtacttaatgaataagct

SEQ ID NO: 4844 - DNA, 490 bp, Unknown
  Ascusbbf_1561127, encodes 16S rRNA
agagtttgatcctggctcaggataaacgctggcggcgtgcataacacatgcaagtcgaacgatgaaacttagatgatttcttcggaatgaacttaagtggattagtggcgaacgggtgagtaacacgtgagtaacctgccttacacaaggggatagcctctggaaacggagaataataccctataaagtctaatcagcacatgctggaaagaccaaagatttatcggtgtaagatggacttgcgtctgattagctagttggtgagataaaagctcaccaaggcgacgatcagtagccggctggagagagtgtacggccacattgggactgagacacggcccaaactcctacgggaggcagcagtggggaattttgcacaatgggggaaaccctgatgcagcgacgccgcgtgatttagaaggccttcgggttgtaaaaatcttttttacgggatgaaaatgacagtaccgtaagaataaggtccggctaa

SEQ ID NO: 4845 - DNA, 187 bp, Unknown
  Ascusbbf_494984, encodes 16S rRNA
agagtttgatcatggctcagatgatcagcccgcaatacgccacggcggattcctgcggttgtcgccggcccggtacagacagatctggttgccggatgggtccgtgaggcgagcctcccgccagagccagcgctgatcgatcgggtgctgcgtgaattcgattccggccgccagcagccgcggtaat

SEQ ID NO: 4846 - DNA, 490 bp, Unknown
  Ascusbbf_1522995, encodes 16S rRNA
agatttgatcctggctcaggatgaacgctagctacaggcttaacacatgcaagtcgaggggcagcaggacgatagcttgctattgttgctggcgaccggcgcacgggtgagtaacgcgtatccaaccttccccttagttgggcatagcccggcgaaagtcggattaataccctatgttcttcgtagaggacttctgaaatgaagcaaagatttatcgctaagggatggggatgcgtctgattaggtagtaggcggggtaacggcccacctagcctacgatcagtaggggttctgagaggaaggtctcccacattggtactgagacacggaccaaactcctacgggaggcagcagtgaggaatattggtcaatgggcgtaagcctgaaccagccaagtagcgtgcaggatgacggccctatgggttgtaaactgcttttgtcggggagcaataagggttacgtgtagcccgatgagagtacctggcgaata

SEQ ID NO: 4847 - DNA, 490 bp, Unknown
  Ascusbbf_1093929, encodes 16S rRNA
agagtttgatcatggctcaggacgaacgctggcggcgtgcttaacacatgcaagtcgaacgagaatctgtggatcgaggattcgtccaagtgaagcagaggacagtggcggacgggtgagtaacgcgtgagcgacctaccttagacagggggacaacagttggaaacgactgctaataccgcataagaccacgatgtcgcatggcattgaggtaaaaggagcaatccggtttaagatgggctcgcgtctgattagctggttggtggggtaacggcctaccaaggcgacgatcagtagccgacctgagagggtgatcggccacactggaactgagacacggtccagactcctacgggaggcagcagtggggaatattgggcaatgggcgaaagcctgacccagcaacgccgcgtgaaggaagaaggtcttcggattgtaaacatctgtcctgtgggacgaacaaatgacggtaccacaggaggaagccccg

SEQ ID NO: 4848 - DNA, 490 bp, Unknown
  Ascusbbf_620130, encodes 16S rRNA
agagtttgatcatggctcaggatgaacgctagctacaggcttaacacatgcaagtcgaggggcagcattatcgaagcttgctttgatagatggcgaccggcgcacgggtgagtaacgcgtatccaaccttccccatagtagggcatagcccgtagaaatgcggattaataccctatgtattccgaggatgacatctgattcggaacaaaggttcaccgctatgggatggggatgcgtctgattaggtagtaggcggggtaacggcccaccaaagcgacgatcagtagccggcctgagagggcggacggccacattgggactgagacacggcccaaactcctacgggaggcagcagtggggaatattgcacaatgggggaaaccctgatgcagccatgccgcgtgtgtgaagaaggccttcgggttgtaaagcacttttgcattcgaggaagacagcgcgtaaataaacgcgttatttgacgttagagtgt

SEQ ID NO: 4849 - DNA, 490 bp, Unknown
  Ascusbbf_1503029, encodes 16S rRNA
agagtttgatcctggctcaggatgaacgctggcggcgtgcctaacacatgcaagtcgaacggtcctcgcaagaggacagtggcgcacgggtgaggaacacgtagctgacctgcctcagagtgcgggataacgccccgaaaggggtgctaataccgcgtaagctcacgggttttagagacctgggagaaaaggccttcgggtcgctttgagagggggctgcggcgcatcaggtagttggtggggtaacggcctaccaagccaacgacgcgtagggggtctgagaggatgatcccccacactgggactgagacacggcccagactcctacgggaggcagcagtgagggatattgcacaatgggggaaaccctgatgcagcgacgccgcgtgggcgatgaaggtcttcggatcgtaaagccctttttgaggtgacgagcaaggacggtagcctcagaataagtctcggctaactacgtgccagcagccgcggt

SEQ ID NO: 4850 - DNA, 490 bp, Unknown
  Ascusbbf_1426121, encodes 16S rRNA
agagtttgatcctggctcaggatgaacgctagcggcaggcttaacacatgcaagtcgaggggcagcgggatgtagcaatacattgccggcgaccggcgcaagggtgcgtaacgcgtgagtaacatgcccgtatcaggaggataacccggagaaatccggactaatactgcataatattgtttagaggcatctttggacaattaaagtttcgacggatacggattggctcgcgtgacattagctagatggtaaggtaacggcttaccatggcgacgatgtctaggggttctgagaggaaggtcccccacactggaactgagacacggtccaaactcctacgggaggcagcagtgaggaatattggtcaatggtcgagagactgaaccagccaagtagcgtgaaggaagactgccctatgggttgtaaacttcttttgtttgggaataaagtgggccacgtgtggccttttgtatgtaccatacgaataagc

SEQ ID NO: 4851 - DNA, 490 bp, Unknown
  Ascusbbf_1636529, encodes 16S rRNA
ctcttttgctcctttctccttcttccctctctctccctgcttcccccatgcaagtcgaggggcatcatgagattagcttgctaatcttgatggcgaccggcgcacgggtgagtaacgcgtatccaaccttccctatactagaggatagcccggcgaaagtcggattaatactctatgttcttcgtagatgacatctgaaatgaagcaaagatttatcggtataggatggggatgcgtctgattagatagtaggcggggtaacggcccacctagtcgacgatcagtaggggttctgagaggaaggtcccccacattggaactgagacacggtccaaactcctacgggaggcagcagtgaggaatattggtcaatgggggaaaccctgacgcagcaacgccgcgtgcgggatgaaggccttcgggttgtaaaccgctttcagtagggaagaaagtgacggtacctacagaagaagctccggctaactacgtg

SEQ ID NO: 4852 - DNA, 490 bp, Unknown
  Ascusbbf_665583, encodes 16S rRNA
agagtttgatcctggctcaggacgaacgctggcggcatgcctaacacatgcaagtcgaacggagattatttcggtaatcttagtggcggacgggtgagtaacgcgtgggtaacctgcctcacacagggggataacagttagaaatgactgctaataccgcataacccgataggatcgcatgatccagacggaaaagatttatcggtgtgagatggacccgcgtctgattagcttgctggcggggtaacggcccaccagggcgacgatcagtaggggttctgagaggaaggtcccccacattggaactgagacacggtccaaactcctacgggaggcagcagtgaggaatattggtcaatggacgagagtctgaaccagccaagtagcgtgcaggaagacggccctatgggttgtaaactgcttttataggggaataaagtgagccacgtgtggttttttgcatgtaccctatgaataaggaccggctaat

SEQ ID NO: 4853 - DNA, 490 bp, Unknown
  Ascusbbf_1787803, encodes 16S rRNA
agagtttgatcctggctcaggatgaacgctagcggcaggcctaatacatgcaagctgaacggtaaatattgtagcaatacgatatgagagtagcgtaagggtgcgtaacacgtatgcaatctgccctgtacaggaggatagctcggggaaactcggattaatactccgtaagatattggtggggcatctcacagatattaaagtcttcggatggtacaggatgagcatgcgtctgattagctagttggtggtgtaacggaccaccaaggcgatgatcagtaggggaactgagaggttgatcccccacactggcactgagatacgggccagactcctacgggaggcagcagtagggaatattggtcaatgggtgagagcctgaaccagccatgccgcgtgcaggaagacggccttctgggttgtaaactgcttttactgggggataaaattctcttgcgagggaaattgaaggtacccggtgaataagcca

SEQ ID NO: 4854 - DNA, 484 bp, Unknown
  Ascusbbf_1426239, encodes 16S rRNA
agagtttgatcatggctcagaacgaacgctggcggcacgcttaacacatgcaagtcgaacgatgtaatggggcttgctccattacatagtggcggacgggtgagtaacacgtggagacctgactagaggaggtggatagctccgggaaactggaggtaatacagcataagctcgagagaggaaaggggaaacccacctttagagggatctgcggctgattaggtagttggtggggtaaaggcctaccaagccgacgatcagtagctggtctgagaggatgatcagccacactggaactgagatacggtccagactcctacgggaggcagcagtggggaatattggacaatggggggaaccctgatccagcgatgccgcgtgagtgaagaaggccttagggttgtaaagctctgtcctcaaggaagataatgacggtacttgaggaggaagccccggctaattacgtgccagcagccgcggtaat

SEQ ID NO: 4855 - DNA, 490 bp, Unknown
  Ascusbbf_1783810, encodes 16S rRNA
agagtttgatcctggctcaggatgaacgctggcggcgtgcctaatacatgcaagtcgaacggagattaagtagcttgctatttaatcttagtggcgcacgggtgagtaatgtatagttaatctgccctacactggaggacaacagttagaaatgactgctaatactccatactccttcttaacacaagttaagtcgggaaagtttttcggtgtaggatgagactatattgtatcagctagttggtgaggtaatggctcaccaaggctatgacgcataactggtctgagaggatgatcagtcacactggaactgagacacggtccagactcctacgggaggcagcagtagggaatgttgctcaatgggggaaaccctgaagcagcaacgccgcgtggaggatgacacttttcggagcgtaaactccttttgtcagggaagaaccatgacggtacctgacgaataagcaccggctaactccgtgccagcagc

SEQ ID NO: 4856 - DNA, 450 bp, Unknown
  Ascusbbf_1133734, encodes 16S rRNA
agagtttgatcctggctcaggatgaacgctagctacaggcttaacacatgcaagtcgaggggcagcatatcgaaagcttgcttttgatgatggcgaccggcgcacgggtgagtaacgcgtatccaaccttccctatactagaggatagcccggcgaaagtcggattaatactctatgttcttcgtagaagacatctgaaatgaagcaaaggtttaccggtataggatggggatgcgtctgattaggttgttggcggggtaacggcccaccaagcccacgatcagtaggggttctgagaggaaggtcccccacattggaactgagacacggtccaaactcctacgggaggcagcagtgaggaatattggtcaatggacgagagtctgaaccagccttgtaggtactgtatgaataaggaccggctaattccgtgccagcagccgcggtaat

SEQ ID NO: 4857 - DNA, 490 bp, Unknown
  Ascusbbf_1378773, encodes 16S rRNA
agagtttgatcctggctcaggatgaacgctagcggcaggcttaacacatgcaagtcgaggggtaacgcggggtagcactactctggcgacgaccggcgcacgagtgcgtaacgcgtatgcaacctacctgtaacaggggtataacggagagaaatttccactaatcccccatattgttagagattcgcatgtttctctaacgaaagcttcggtggttacggatgggcatgcgtgacattagctagttggtaaggtaacggcttaccaaggcgacgatgtctaggggagctgagaggcttatccccaacacaggtactgggacacggaccagactcatacgggaggcagcaggggggaatatgggtaaatggacggaagtcgaaacaagccaggccgggtggaggaagaaggtcctatgggtggtaaacgccttttgttcgagagtaagaagaggctggcgagcctcgatgagagtatcggacgaataagc

SEQ ID NO: 4858 - DNA, 490 bp, Unknown
  Ascusbbf_1378761, encodes 16S rRNA
agagtttgatcatggctcaggatgaacgctagctacaggcttaacacatgcaagtcgaggggtaacgacagcgaaagcttgcttttgctgggcgacgaccggcgaatgggtgagtaacgcgtatccaacctgccgcaaagtagggcacagtcttgcgaaagtaagattaatgccctatgtgctgtgatcaggacatctgaattgcagtaaaggttcaccgctttgcgatggggatgcgtctgattaggttgttggcggggtaacggcccaccaagcccgcgatacgtaggggttctgagaggacaagctgcccaattggaactgagagccggtccaaaatcctgcgggaggcaggagtgaggaatattggacaaggggcggacgtcggaaaaagccatgccgcgtggaggaagaaggtcctatgggttgtaaactccttttgttcgagagtaataagggctttgcgaagcccgatgagagtatcggacga

SEQ ID NO: 4859 - DNA, 203 bp, Unknown
  Ascusbbf_1413454, encodes 16S rRNA
agagtttgatcctggctcagatttcacggcggataacgtggtagtaatgaatggtgctaaaatgacgctgtacgctctgggacaagcactgtttgatgaaggcgacgaggttttgattcctttgccatactgggtaacctatggcgaacaggttaagctggccggtgccaagccagtcttcgtcaagccagcagccgcggtat

SEQ ID NO: 4860 - DNA, 490 bp, Unknown
  Ascusbbf_776828, encodes 16S rRNA
agagtttgatcctggctcaggacgaacgctggcggcgtgcttaacacatgcaagtcgagcgaggacggcaccttcgggtgtcgagccgagcggcggacgggtgaggaacacgtaagcgatctatcctcgtgcgggggacaacccggggaaacccggactgataccgcatgggccgacagcccgcatgggcggtcggggaaaggcggcctctgcttatgcaagctgtcgcgcggggaggagcttgcggcctatcagctagttggtgaggtaacggctcaccaaggcggtgacgggtagcgggtctgagaggacggcccgccacattgggactgagacacggcccagactcctacgggaggcagcagtgaggaatattggtcaatgggcggaagcctgaaccagccatgccgcgtgcaggaatgaggccctacgggtcgtgaactgcttttcgcgcggagcaataaggggggttcgcccctccgatgagagt

SEQ ID NO: 4861 - DNA, 490 bp, Unknown
  Ascusbbf_1122313, encodes 16S rRNA
aaagtttgatcatggctcagaacgaacgcttgcggcatgcttaaaacatgcaagtcgaacgagaaagggacttcggtcctgagtacagtggcgcacgggtgagtaacacgtaactaacgtcccttatcgctggggataactccgggaaaccggagctaataccgaatgatctaagagagtctctgggctttcttggtaaagcttccgggcgcgatgagatcgggttgcggcccattagcttgttggtggggtaatggcctaccaaggctacgatgggtagctggtctgagaggatgatcagccacactggaactgaaacacggtccagactcccacgggaggcagcagttgggaatattggacaatgggggaaaccctgatccagcaatgccgcgtgaatgatgaaggccctcgggtcgtaaagttcttttagcagggaagaagggaaacttgaccgtacctgcagaaaaagcaccggctaactccgtgc

SEQ ID NO: 4862 - DNA, 490 bp, Unknown
  Ascusbbf_1070647, encodes 16S rRNA
agagtttgatcctggctcaggatgaacgctagcgataggcttaacacatgcaagtcgaggggcagcaaggggtagcaatactctgttggcgaccggcggatgggtgagtaacacgtatgcaacctgccctctactcagggatagcccgttgaaagacggattaatacttgatattattaattatccgcatggattattaatgaaagatttattggtagaggatgggcatgcgtttcattagcttgttggtgaggtaacggctcaccaaggcaacgatgaataggggaactgagaggtttatcccccacactggaactgagacacggaccagactcctacgggaggcagcagtgaggaatattggtcaatggacgcaagtctgaaccagccaagtcgcgtgatggatgactgccttatgggttgtaaacatcttttatatgggaataaagtgctctacgtgtagggttttgcaagtaccatatgaataagc

SEQ ID NO: 4863 - DNA, 490 bp, Unknown
  Ascusbbf_1010027, encodes 16S rRNA
agagtttgatcctggctcagagtgaacgctggcggcaggcctaacacatgcaagtcgaacggcagcgcggggagcttgctccttggcggcgagtggcggacgggtgaggaatacatcggaatctgcctatttgtgggggataacctcgggaaaccgggactaataccgcatacgacctacgggtgaaagcggaggaccttcgggcttcgcgcagatagatgagccgatgtcggattagatagttggtgaggtaatggctcaccaagtcgacgatccgtagctggtctgaggggatgaccagccagactggaactgagacacggtccagactcctacgggaggcagcagtgaggaatcttccacaatgggcgaaagcctgacggagcaacgccgcgtgagtgatgacggccttcgggttgtaaagctctgtgatcggggacgaacggtccgtaagctaataccttatggaagtgacggtacccgaatagca

SEQ ID NO: 4864 - DNA, 490 bp, Unknown
  Ascusbbf_1767632, encodes 16S rRNA
agagtttgatcctggctcaggacgaacgctggcggcgtgcttaacacatgcaagtcgaacggaaaggcctcttcgggggtactcgagtggcgaacgggtgagtaacacgtgggtaacctgcccctggctttgtgataactccgggaaaccggggctaataccggatggtgactgtctgccgcatggtgggtggttgaaagtttttcggctggggatgggcccgcggcctatcagcttgttggtggggtgatggcctaccaaggcggtgacgggtagccggcccgagagggtgaccggccacactgggactgagacacggcccagactcctacgggaggcagcagtggggaatattgcgcaatgggcggaagcctgacgcagcgacgccgcgtgagggatgacggccttcgggttgtaaacctctttcagctctgacgaagctttcgggtgacggtaggagcagaagaagcaccggccaactacgtgccag

SEQ ID NO: 4865 - DNA, 470 bp, Unknown
  Ascusbbf_1640995, encodes 16S rRNA
agagtttgatcctggctcagaacgaacgctggcggcaggcctaacacatgcaagtcgaacgccctagcaatagggagtggcgcacgggtgagtaacgcgtgggaatgtacccttgggtgcggaacaacatcgggaaactgatgctaataccgcataatatctacggatcaaagatttatcgcccaaggatcagcccgcgtaagattaggtagttggtggggtaacggctcaccaagccgacgatctttagctggtcttagaggatgatcagccacactgagactgagacacggcccagactcctacggggggcagcagtgaggaatcttggacaatgggggaaaccctgatccagccatgccgcgtgagtgatgaaggccttcgggttgtaaagctctttcagatgtgaagataatgacggtagcatcagaagaagctccggctaactccgtgccagcagccgcggtaat

SEQ ID NO: 4866 - DNA, 490 bp, Unknown
  Ascusbbf_1532648, encodes 16S rRNA
agagtttgatcctggctcaggatgaacgctggcggcaggcttaatacatgcaagttgaacggtaacagatttggtagcaatactagatgctgacgagtggcgtacgggtgcgtaacacgtgtgtaacctaccttatacaggaacaaaacatcgagaaattggtgctaatattccataatattatgtataggcatctatatataattaaagctacggtggtataagatgggcacgcggtccattagctagttggtatggtaacggcataccaaggcgacgatggataggggttctgagaggaaagtcccccacattggaactgagacacggtccaaactcctacgggaggcagcagtgaggaatattggtcaatggccgagaggctgaaccagccaagtagcgtgcaggacgactgccttacaggttgtaaactgcttttatgcaagagtaaagtgagctacgtgtagtttattgcaagtattgcatgaat

SEQ ID NO: 4867 - DNA, 490 bp, Unknown
  Ascusbbf_1092362, encodes 16S rRNA
agagtttgatcatggctcaggatgaacgctagcgggaggcctaacacatgcaagccgagcggtatagttctttcgggaactagagagcggcgtacgggtgcggaacacgtgtgcaacctgcccttatcaaggggatagcccggagaaattcggattaataccctataatatatggtgaggcatctcactatattaaaaactgaggtggataaggatgggcacgcgcaagattagctagttggtgaggtaacggctcaccaaggcgacgatctttagggggcctgagagggtgatcccccacactgggactgagacacggcccagactcctacggggggcagcagtgaggaatattggacaatgggtggaagcctgatccagccatcccgcgtgaaggatgaaggttctatggattgtaaacttcttttgtatagggataaacctactctcgtgagggtagctgaaggtactatacgaataagcaccggct

SEQ ID NO: 4868 - DNA, 490 bp, Unknown
  Ascusbbf_1471084, encodes 16S rRNA
agagtttgatcctggctcagattgaacgctggcggcatgcttaacacatgcaagtcgaacggcagcatgacctagcttgctaggttgatggcgagtggcgaacgggtgagtaacgcgtaggaatatgccttaaagagggggacaacttggggaaactcaagctaataccgcataatttcttaggaaaaaagctggggatcgtaagacctggcgctttaagattagcctgcgtccgattagctagttggtagggtaaaggcctaccaaggcgacgatcggtagctggtctgagaggatgaccagccacactggaactgagacacggtccagactcctacgggaggcagcagtggggaatattggacaatgggggcaaccctgatccagcaatgccgcgtgtgtgaagaaggcctgagggttgtgaagcactttcagtggggaggaggattttctggttaagagctggagaattggacgttacctacagagg

SEQ ID NO: 4869 - DNA, 490 bp, Unknown
  Ascusbbf_1420068, encodes 16S rRNA
agagtttgatcctggctcagagcgaacgctggcggcgtgcctaacacatgcaggtcgaacgtgaacggcttcggcctagtaaagtggcgtacgggtgagtaacacgtggataatctaccctagagtctggaataacctgccgaaaggcgggctaatactggatagagcgacgaaatctgtaattgggtttttcgggaaagggagctcgctagagccctcgctttaggatgagtctgcgtcccattaggtagttggtggggtaatggcctaccaagcctgtgatgggtagctggtctgagaggatgatcagtcacactggaactgagacacggtccagacacctacgggaggcagcagtggggaatattggacaatgggcgaaagcctgatccagccatgccgcgtgtgtgaagaaggtcttcggattgtaaagcactttaagttgggaggaagggttgtagattaatactctgcaattttgacgttacca

SEQ ID NO: 4870 - DNA, 490 bp, Unknown
  Ascusbbf_1151552, encodes 16S rRNA
agagtttgatcatggctcaggataaacgctggcggcgtgcctaatgcatgcaagtcgcacgggagccctttcgggggtcgaccgtggcggacgggtgaggaacacgtggctaacctgcccaacagtgggggataacctcgggaaaccgaggctaataccgcatacgcttagtttcgggaacggagctaaggaaaggagtaatccgctgatggagggggctgcggccgattagctagttggtggggtaagagcctaccaaggcggtgatcggtagctggtctgagaggacgatcagccacacggggactgagacacggccccgactcctacgggaggcagcagcaaggaattttccacaatgggcgcaagcctgatggagcaacgccgcgtgggggatgacgcttttcggagtgtaaaccccttttcgagaggacgaagccaatgacggtactctcggaataaggaccggctaactacgtgccagcagccg

SEQ ID NO: 4871 - DNA, 490 bp, Unknown
  Ascusbbf_972528, encodes 16S rRNA
agagtttgatcctggctcaggacgaacgctggcggtgtgcttaacacatgcaagtggagcgacgaaccagggcttgccctggggcaaagccgcgaacgggtgagtaacacgtgggtaacctgccccgatgactgggacaacccgaggaaactcgggctaataccggatgtcctcatcactcacgagagtgatgagcaaagatagcttcggctttcgcattgggaggggcccgcggcccattagcttgttggtggggtaacggcctaccaaggcaacgatgggtagctggtctgagaggacgatcagccacactgggactgagacacggcccagactcctacgggaggcagcagtggggaatcttgcgcaatgcgcgaaagcgtgacgcagcaacaccgcgtgagggaagacggccttcgggttgtaaactgcttttgtatggggataaagtgctccacgtgtggagttttgtaggtaccatacgaataag

SEQ ID NO: 4872 - DNA, 466 bp, Unknown
  Ascusbbf_1418748, encodes 16S rRNA
agagtttgatcctggctcaggatgaacgctggcggcgtgcctaacacatgcaagtcgaacggtcaaaccgccctcgggcggagatagagtggcgaacgggtgagtaacacgtgaccaacctgccccgcgcaccgggacaaccccccgaaagggggattaataccggatactccggcggcgcgggatggggtcgcggcccatcaggtagacggccgggtagaggccggccgtgccgacgacgggtaaccgggttgagagaccgaccggccacattgggactgagatacggcccagactcctacgggaggcagcagtggggaatattgcgcaatgggggcaaccctgacgcagcaacgccgcgtgcgggacgaaggcactcgtgtcgtaaaccgctttcagcagggaagacatcgacggtacctgcagaagaagccccggctaactacgtgccagcagccgcggtaat

SEQ ID NO: 4873 - DNA, 490 bp, Unknown
  Ascusbbf_1487849, encodes 16S rRNA
agagtttgatcctggctcaggatgaacgttggcggcatgcctaacacatgcaagtcgaacgcgaggcttcggtctcgagtggcgaacgggtgcgtaacacgtaggtgacctgcccagcagtgggggataaccagcggaaacgctggctaataccgcatacgtgtacgagggtttgagactcgtacagaaagctcaatgtgctgctggaggggcctgcggcctatcaggtagttggtggggtaacggctcaccaagccgatgacgggtagctgacctgagagggtggtcagccacaggggaactgagagacggtccccactcctacgggaggcagcagtgagggatattggtcaatggccgagaggctgaaccagcaatgccgcgtgcgggaggacgcccttcggggtgtaaaccgcttttctgggggacgagacaaggacggtaccccaggaacaagttacggctaactacgtgccagcagccgcggtaa

SEQ ID NO: 4874 - DNA, 490 bp, Unknown
  Ascusbbf_1619739, encodes 16S rRNA
agagtttgatcctggctcaggatagacgctggcggcgcacataagacatgcaagtcgaacggacttaattcgttagtttactaatggaagcggttagtggcggactggtgagtaacgcgtaagcaacctgcctattagtagggaataacagtgagaaatcattgctaataccgtataagctggaaacatcgcatgatgtagtcagaaaaggagcaattcgctaatagatgagcctaagtcggattagctagttggtggggtaaaggcctaccaaggcgacgatctgtagcgggtctgagaggatgatccgccacactgggactgagacacggcccagactcctacgggaggcagcagtgaggaatattggacaatgggggaaactctgacgcagtgacgccgcgtgcaggaagaaggttttcggattgtaaactgctttagacagggacgaaacaaatgacggtacctgtagaataagctccggctaact

SEQ ID NO: 4875 - DNA, 490 bp, Unknown
  Ascusbbf_1766751, encodes 16S rRNA
agagtttgatcatggctcaggatgaacgctagcgggaggcttaatacatgcaagtcgtacggtaacatgtccttcgggatgatgacgagtggcggacgggtgagtaacgcgtacacgatctacctataagtctgggatagtcactggaaacggtgaataatatcggatgtggatatattgcttcatggtgatatatttaaaggctagactgcttatagatgagtgtgcgtcctattagttagttggagaggtaacggctccccaaggcgatgataggtagggggcgtgagagcgtggacccccacacgggtactgagacacggacccgactcctacgggaggcagcagtaaggaatattggacaatgggcgagagcctgatccagccatcccgcgtgcaggaagacagccctatgggttgtaaactgcttttataagggaagaacgtccccgattgatcggggtatgacggtaccttaggaataagcacc

SEQ ID NO: 4876 - DNA, 472 bp, Unknown
  Ascusbbf_1896136, encodes 16S rRNA
agagtttgatcatggctcagagcgaacgctggcggcaggcttaacacatgcaaatcgaacggccgtagcaatacggcagtggcagacgggtgagtaacacgtgggaatgtacccttcggttcggaataacccagggaaacttgggctaataccggatacgcccttacggggaaagatttattgccgaaggatcagcccgcgtccgattagctagttggtggggtaatggcccaccaaggcgacgatcggtagctggtctgagaggatgatcagccacactgggactgagacacggcccagactcctacgggaggcagcagtggggaatattggacaatgggcgcaagcctgatccagccatgccgcgtgggtgatgaaggccctagggttgtaaagccctttcggcggggaagataatgacggtacccgcagaagaagccccggctaacttcgtgccagcagccgcggtaat

SEQ ID NO: 4877 - DNA, 490 bp, Unknown
  Ascusbbf_1799989, encodes 16S rRNA
agagtttgatcctggctcaggatcaacgctggcggcgtgcctagtgcatgcaagtcgaacgggcttcccttcgggggagtcacgtggcggacgggtgaggaacacgtgggcgacctaccctggggcgggggatagccgcgagaaatcgtggataattccgcatacgctccctcccgtgttgtgggggggaggaaaggtgcgtttcggcgcgccacccttggcggggcctgcggccgattagttagttgggggggtaacggcctcccaaggcgatgatcggtagctggtctgagaggacggccagccaaacggggactgagacacggccccgactcctacgggaggcagcagcaaggaatcttccgcaatgggcgaaagcctgacggagcaacgccgcgtgcgggatgacgcccttcggggtgtaaaccgcttttacggggggataaagtgagtgatgtgtcattcattgcaggtaccccgcgaataagga

SEQ ID NO: 4878 - DNA, 490 bp, Unknown
  Ascusbbf_795219, encodes 16S rRNA
agagtttgatcctggctcaggatgaacgctagctacaggcttaacacatgcaagtcgaggggcagcatgcaggaagcttgcttcttgtgatggcgaccggcgcacgggtgcgtaacgcgtatccaatctaccctatactcggggacagccctgcgaaagtaggattaatacccgatgttcttatgatgccgcatgacattataagcaaagatttattggtataggatgaggatgcgtcccattaggcagtaggcggggtaacggcccacctaaccgacgatgggtaggggttctgagaggaaggtcccccacattggaactgagacacggtccaaactcctacgggaggcagcagtgaggaatattggtcaatgggcgagagcctgaaccagccaagtagcgtgcaggaagacggccctatgggttgtaaactgcttttataggggaataaagtgagccacgtgtggttttttgcatgtaccctatgaat

SEQ ID NO: 4879 - DNA, 485 bp, Unknown
  Ascusbbf_1198901, encodes 16S rRNA
agagtttgatcctggctcagaacgaacgctggcggcatgcctaacacatgcaagtcgaacgggatcttcggatctagtggcggacgggtgagtaacgcgtgggaacctgcccttgggtacggaataacagttggaaacgactgctaataccgtatacgtccccctttggttgacattgggggagaaagatttatcgcccttggaggggcccgcgtgagattaggtagttggtggggtaatggcctaccaagccgacgatctctagctggtttgagaagatgatcagccacactgggactgagacacggcccagactcctacgggaggcagcagtggggaatattggacaatgggggcaaccctgatccagcaatgccgcgtgagtgaagaaggccttagggttgtaaagctcttttacccgggaagataatgacggtaccgggagaataagccccggctaactccgtgccagcagccgcggtaat

SEQ ID NO: 4880 - DNA, 490 bp, Unknown
  Ascusbbf_1200639, encodes 16S rRNA
agagtttgatcatggctcaggacgaacgctggcggcgcgcctaacacatgcaagtcgaacggagaaaggaaagcttgcttttctttcttagtggcggacgggtgagtaacacgtgagcaacctgccttacagagggggataacgttctgaaaagaacgctaataccgcataacacagttttggggcatcctggaattgtcaaaggagcaatccgctgtaagatgggctcgcgtccgattaggcagttggcggggtaacggcccaccaaaccgacgatcggtagccggactgagaggttgaacggccacattgggactgagacacggcccagactcctacgggaggcagcagtgggggatattgcacaatgggggaaaccctgatgcagcgacgccgcgtgagggaagaaggttttcggattgtaaacctctgtcttcggtgacgaaaatgacggtaaccgaggaggaagccacggctaactacgtgccag

SEQ ID NO: 4881 - DNA, 490 bp, Unknown
  Ascusbbf_775784, encodes 16S rRNA
agagtttgatcatggctcaggatgaacgctgacagaatgcttaacacatgcaagtcgatggggaagtggtacttgtcactatgggaaccatggcggacgggtgagtaacgcgtaaaggacttaccttttagactgggataacagtcggaaacgactgataagactggatataattaaggattcgcatgaatttttaatgaaaagaggagctaaaagagagctttgcgtcctattagctagttggtgaggtagaggctcaccaaggcgatgataggtagccggcctgagagggtgaacggccacaaggggactgagatacggcccttactcttacgggaggcagcagtggggaatattggacaatggagggaactctgatccagcaattctgtgtgcacgaagacggttttcggattgtaaagtgctttcagtagggaagaagtaagtgacggtacctacagaagaagcgacggctaaatacgtgccagca

SEQ ID NO: 4882 - DNA, 470 bp, Unknown
  Ascusbbf_1118643, encodes 16S rRNA
agagtttgatcctggctcagaacgaacgctggcggcaggcttaacacatgcaagtcgagcgctgtagcaatacagagcggcagacgggtgagtaacgcgtggggatgtacccagaggtacggaacaacttcgggaaactggagctaataccgtatgtgaccgtgaggtgaaagatttatcgcctttggatcaacccgcgtcagattagctagttggtagggtaatggcctaccaaggcgacgatctgtagctggtctgagaggatgatcagccacattgggactgagacacggcccaaactcctacgggaggcagcagtggggaatattggacaatgggcgcaagcctgatccagccatgccgcgtgagtgatgacggccttagggttgtaaagctctttcgctcgcgacgataatgacggtagcgagagaagaagccccggctaacttcgtgccagcagccgcggtaat

SEQ ID NO: 4883 - DNA, 490 bp, Unknown
  Ascusbbf_765065, encodes 16S rRNA
agagtttgatcatggctcaggatcaacgctggcggcgtgcctaatgcatgcaagtcgaacggagccgccttcgggcggtcacgtggcggacgggtgaggaacacgtgggcgatctgccccgaggcgggggatagctaccagaaatggtaggtaataccgcatgagcttcccgggttacggccggggaaggaaagtcgcgagacgccttgggaggagcctgcggcggattagctggttggtggggtaacggcctaccaaggcgatgatccgtagctggtctgagaggatggccagccacaggggaactgagacacggtccccactcctacgggaggcagcagcaaggaattttccgcaatgggtgaaagcctgacggagcaacgccgcgtgggggatgacgcttttcggagtgtaaaccccttttctcagggatgaaaccaatgacagtacctgaggaataaggaccggctaactacgtgccagcagccgc

SEQ ID NO: 4884 - DNA, 490 bp, Unknown
  Ascusbbf_1851741, encodes 16S rRNA
agagtttgatcctggctcaggatgaacgctgacagaatgcttaacacatgcaagtcaatgagaagacttctcttcggagaagaggttatcatggcggacgggtgagtaacgcgtaaagaacttaccttatggtctgggataacagttggaaacgactgataacactggatactatgacagtttcgcatgaaactgttatgaaaagcaatgtcataagagagctttgcgtcctattagctagttggtgaggtaaaggctcaccaaggcgatgataggtagccggcctgagagggtgaccggccacaaggggactgagatacggcccttactcttacgggaggcagcagtggggaatattggacaatggaggcaactctgatccagcaattctgtgtgcacgaagaaggttttaggattgtaaagtgctttcagttgggaagaagcaagtgacggtaccaacagaagaagcgacggctaaatacgtgccagc

SEQ ID NO: 4885 - DNA, 490 bp, Unknown
  Ascusbbf_888701, encodes 16S rRNA
agagtttgatcctggctcaggacgaacgctggcggcgtgcctaacacatgcaagtcgaacggtaaggcccttcggggtacacgagtggcgaacgggtgagtaacacgtgagcaacctgcccttgacttcggaataagcactcgaaagggtgcctaataccggatatgaccctcaccgacatcggagagggttgaaagccctggcggtcaaggatgggctcgcggcctatcagctagttggtgaggtaacggctcaccaaggcgtcgacgggtagccggcctgagagggcgaccggccacactgggactgagatacggcccagactcctacgggaggcagcagtggggaatattgcacaatgggcgaaagcctgatgcagcaacgccgcgtgcgggatgacggccttcgggttgtaaaccgctttcagtagggacgaagcgaaagtgacggtacctacagaagaagcaccggccaactacgtgccagcagc

SEQ ID NO: 4886 - DNA, 472 bp, Unknown
  Ascusbbf_1851187, encodes 16S rRNA
agagtttgatcatggctcagaacgaacgctggcggcaggcttaacacatgcaagtcgaacgggtgtagcaatacatcagtggcagacgggtgagtaacacgtgggaaccttcctcgttgtacggaacaactcagggaaacttgagctaataccgtatacgtccgagaggagaaagatttatcgcaatgagacgggcccgcgtcggattagctagttggtagggtaacggcctaccaaggcaacgatccgtagctgatctgagaggaggatcagccacactgggactgagacacggcccagactcctacgggaggcagcagtggggaatcttggacaatgggcgcaagcctgatccagccatgccgcgtgagtgaagaaggccttagggttgtaaagctcttttgccagggacgataatgacggtacctggagaataagccccggcaaacttcgtgccagcagccgcggtaat

SEQ ID NO: 4887 - DNA, 490 bp, Unknown
  Ascusbbf_1209286, encodes 16S rRNA
agagtttgatcctggctcaggatgaacgctagcgacaggcttaacacatgcaagtcgaggggcagcatggcggtggcaacaccgccgatggcgaccggcgcactggtgagtaacacgtatgcaacctgccccctgccggggaataaaccagggaaacttggcctaatgccgcataacacatcgtccggcatcggacggtgttgaaagctccggcggcaggggatgggcatgcgccgcattagcttgtaggcggggtgacggcccacctaggcgacgatgcgtaggggttctgagaggaaggtcccccacactggtactgagacacggaccagactcctacgggaggcagcagtgaggaatattggtcaatgggcgagagcctgaaccagccaagtagcgtgcgggacgaaggccctatgggttgtaaaccgcttttacggggggataaagtgagtgacgtgtcattcattgcaggtaccccgcgaataag

SEQ ID NO: 4888 - DNA, 490 bp, Unknown
  Ascusbbf_1013522, encodes 16S rRNA
agagtttgatcctggctcaggacgaacgctggcggcatgcctaacacatgcaagtcgaacggaataggattggttgtagcgatacttttgatcctatttagtggcgaacgggtgagtaacacgtgagcaacctgccttttacacagggataacagccggaaacggctgctaataccggataagaccacaccgaggcatctcggaggggtcaaagcgcttagcggtaaaagatgggctcgcgtcccattagctagttggtgaggtaacggcccaccaagaccgcgatcggtagccggactgagaggttgaacggccacattgggactgagacacggcccagactcctacgggaggcagcagtggggaatattgcacaatgggggaaaccctgatgcagcgacgccgcgtgagtgaagaagtatttcggtatgtaaagctctatcagcaaggaagataatgacggtacttgactaagaagccccggctaact

SEQ ID NO: 4889 - DNA, 490 bp, Unknown
  Ascusbbf_1855665, encodes 16S rRNA
agagtttgatcctggctcagcctgaacgctggcggcgtggctaagacatgcaagtcgtacggacgtagcaatacgtcagtggcggacgggtgagtaatgtatcgctaatgtacccttcactctgggatagccgtgggaaactgcgggtaataccagatgacataaccgaatcgcatggtttggttctcaaaggagcaatacggtgagggagcaggcgatatcgtatcagcttgttggtgaggtaatggctcaccaaggcgacgacgcgtagctggtctgagaggacggccagccacattgggactgagacactgcccagactcctacggggggctgcagtaacgaatcttccgcaatgcacgcaagtgtgacggagcgacgccgcgtggaggttaagtccttcgggatgtaaactcctgtcaggggttaccaagatctgaggagccccagaggaaggcacggctaactctgtgccagcagccgcggtaat

SEQ ID NO: 4890 - DNA, 490 bp, Unknown
  Ascusbbf_896278, encodes 16S rRNA
agagttgatcatggctcaggatgaacgctagctacaggcttaacacatgcaagtcgaggggcagcatgaaatcagcttgctgactttgatggcgaccggcgcacgggtgcgtaacacgtatccaatctacccatggctcagggatagcctttcgaaagaaagattaatacctgatggtctgtgattgagacatctcgaacacagtaaagattaatcggcgatggatgaggatgcgtctgattagatagtaggcggggtaacggcccaccaagtcagcgatgggtagctggtgtgagagcacgaccagccacacgggcactgagacacgggcccgactcctacgggaggcagcagtgaggaatattggtcaatggacgcaagtctgaaccagccatgccgcgtggaggatgacagccttctgggttgtaaacttcttttatatgggaagaacagcatggtttctactatgtccgacggtaccatatgaata

SEQ ID NO: 4891 - DNA, 490 bp, Unknown
  Ascusbbf_872060, encodes 16S rRNA
agagtttgatcctggctcaggacgaacgctggcggcgtgcttaacacatgcaagtcgaacgaggtccacggtgtcgcaagacacctgaagacctagtggcgaacgggtgcgtaacacgtgagaaacttgtcccggtctctggaataacagttggaaacaactgctaataccggatgccgtcggaccatcgcatggtggactgacgaaagggttaccggatcgggagagtctcgcggcctatcagcttgttggtgaggtaatggctcaccaaggcatcgacgggtagctggtctgagaggatgatcagccacactgggactgagacacggcccagactcctacgggaggcagcagtggggaatcttgcacaatgggcgaaagcctgatgcagcaacgccgcgtgcgggaagaaggccctagggttgtaaagctctttcaccggtgaagataatgacggtaaccggagaagaagccccggctaacttcgtgc

SEQ ID NO: 4892 - DNA, 490 bp, Unknown
  Ascusbbf_964974, encodes 16S rRNA
agagtttgatcctggctcagattgaacgctggcggtatgcttaacacatgcaagtcgaacggcagcatgatgtgtagcaatacacattgacggcgagtggcggacgggtgagaaacgcgtaggaatctgccttatagagggggacaactagaggaaactctagctaataccgcataatgtctacggaccaaacgctggggcaacctggcgccataagaggagcctgcgtccgattagctagttggtggggtaaaggcctaccaaggcgatgatcggtagctggtctgagaggatgatcagccacactgggactgagacacggtccaaactcctacgggaggcagcagtgaggaatattggtcaatgggcgagagcctgaaccagccaagtagcgtgcaggaagacggccctatgggttgtaaactgattttgtatggggataaagtgctccacgtgtggagttttgtaggtaccatacgaataaggaccg

SEQ ID NO: 4893 - DNA, 490 bp, Unknown
  Ascusbbf_964588, encodes 16S rRNA
agagtttgatcctggctcaggatgaacgctagctacaggcttaacacatgcaagtcgagcgatcccttcggggatagcggcggacgggtgagtaacgcgtgggaacgtgcccttttcttcggaatagcccagggaaacttggattaataccggatacgcccttcgggggaaagatttatcggaaaaggatcggcccgcgttggattaggtagttggtggggtaatggcctaccaagccgacgatccatagctggtttgagaggatgatcagccacactgggactgagacacggcccagactcctacgggaggcagcagtgaggaatattggtcaatgggcgtgggcctgaaccagccaagtagcgtgcaggatgacggccctatgggttgtaaactgcttttgtatggggatagagtgctccacgtgtggggcattgcaggtaccatacgaataaggaccggctaattccgtgccagcagccgcggtaat

SEQ ID NO: 4894 - DNA, 490 bp, Unknown
  Ascusbbf_1725703, encodes 16S rRNA
agagtttgatcctggctcagaatgaacgttggcggcgtgcttaacacatgcaagtcgagcgagaaagttccttcgggaatgagtacagcggcggacgggtgtggaacgcgtgagaatctgccctttagtgaagaatacccttgagaaattgaggataatactgcatattcccttcgggggaaagatggctttatgctgtagctagaggatgagcttgcgtgctattagctagttggtgaggtaatggctcaccaaggcgatgatggctagccggcctgagagggtgtgcggccacattgggactgagatacggcccagactcctacgggaggcagcagtgaggaatattggtcaatgggcgagagcctgaaccagccaagtagcgtgcaggatgactgccctatgggttgtaaactgcttttatgcggggataaagtgacgtacgcgtacgtttttgcaggtaccgcatgaataaggaccggctaattcc

SEQ ID NO: 4895 - DNA, 490 bp, Unknown
  Ascusbbf_1222765, encodes 16S rRNA
agagtttgatcctggctcagattgaacgctggcggcaggcttaacacatgcaagtcgtacggtaacagagggaagcttgcttctctgctgacgagtggcggacgggtgagtaacacgtgagaaacctgccccaaagactgggatgagccttggaaacgaggtctaataccggataccttctcttcatctcctgatgataagaagaaatgctccggcgctttgggatggtctcgcgacctatcagcttgttggtgaggtaaaagctcaccaaggctacgacgggtagctggtctgagaggatgtccagccacactggaactgagatacggtccagactcctacgggaggcagcagtagggaatcttgcacaatgagggaaaccttgatgcagcgacgccgcgtgcgggacgaaggccctagggttgtaaaccgctttcagttgggacgaaagtgacggtaccaacagaagaagccccggccaactatgtgc

SEQ ID NO: 4896 - DNA, 490 bp, Unknown
  Ascusbbf_1244773, encodes 16S rRNA
agagtttgatcatggctcaggacgaacgctggcggcatgcctaacacatgcaagtcgaacggagaactccttcgggggttcttagtggcgaacgggtgagtaacgcgtaggcaacctgccctttggatggggacaacattccgaaaggagtgctaataccgaatgtgacgattttaccgcatggtttaatcgtgaaagatggcctctacatgtaagctatcgccaaaggatgggcctgcgtctgattagctagttggtggggtaacggctcaccaaggcgacgatcagtagccggtctgagaggatgatcagccacactgggactgagacacggcccagactcctacgggaggcagcagtggggaatattggacaatgggcgaaagcctgatccagcaatgccgcgtgtgtgaagaaggtcttcggattgtaaagcactttcgacggggacgatgatgacggtacccgtagaagaagccccggctaactt

SEQ ID NO: 4897 - DNA, 490 bp, Unknown
  Ascusbbf_769582, encodes 16S rRNA
agagtttgatcatggctcagaacgaacgctggcggcaggcctaacacatgcaagtcgagcgaacccttcgaggttagcggcggacgggtgagtaacgcgtgggaatatgcccttctctacggaatagtctcgggaaactgggggtaataccgtatacgccctttgggggaaagatttatcggagaaggattagcccgcgttggattaggtagttggtggggtaatggcctaccaagcctacgatccatagctggtttgagaggatgatcagccacactggaactgagacacggtccagactcctacgggaggcagcagtgaggaatattggtcaatgggcgagagcctgaaccagccaagtagcgtgcaggatgacggccctatgggttgtaaactgcttttatatgaggataaagttcgttacgtgtaacgttttgcaggtatcatatgaataaggaccggctaattccgtgccagcagccgcggtaat

SEQ ID NO: 4898 - DNA, 490 bp, Unknown
  Ascusbbf_847445, encodes 16S rRNA
agagtttgatcctggctcagattgaacgctggcggcaggcttaacacatgcaagtcgggcggtaacaggggagcttgctcccgctgacgagcggcggacgggtgagtaatgcatgggaatctgcccggtaatgggggatagcccggggaaacccggattaataccgcatacgccctacgggggaaagcaggggatcttcggaccttgcgttatcggatgagcccatgtcggattagctagttggtagggtaaaggcctaccaaggcgacgatccgtagctggtttgagaggatgatcagccacactgggactgagatacggcccagactcctacgggaggcagcagtcgggaatattgcgcaatggaggaaactctgacgcagtgacgccgcgtgcaggaagaaggttttcggattgtaaactgctttagacagggaagaacaaagacagtacctgtagaataagctccggctaactacgtgccagcagc

SEQ ID NO: 4899 - DNA, 153 bp, Unknown
  Ascusbbf_1604897, encodes 16S rRNA
agagtttgatcatggctcagaaggagtgcaatccggaactgttttttcagtttgcgcagaaagtccagtaagtgatcaatggcgtgaggctgtttatcaaaataataatgaaccgactactttagctctaggaatgccagcagccgcggtaat

SEQ ID NO: 4900 - DNA, 490 bp, Unknown
  Ascusbbf_1709310, encodes 16S rRNA
agagttgatcctggctcaggataaacgctggcggcgcacataagacatgcaagtcgaacggacttaattcgttagtttactaatggaagcggttagtggcggttgggtgagtaacgcgtatccaacctggccctatctcggggacagcccctcgaaagagggattaatacccgatgttccctggtttccgcatgtttaccagggcaaaggcatattgtcggatagggatggggatgcgttccattaggcagtcggcggggtaacggcccaccgagcctacgatggataggggttctgagaggaaggccccccacactgggactgagacacggcccagactcctacgggaggcagcagtgaggaatattggtcaatggcggcaacgctgaaccagccaagtagcgtgagggattactgccctatgggttttaaacctcttttgttggggagcaaccggcatcacttgtggtgccctgcgagtacccttcga

SEQ ID NO: 4901 - DNA, 490 bp, Unknown
  Ascusbbf_918578, encodes 16S rRNA
agagtttgatcatggctcaggatgaacgctagctacaggcttaacacatgcaagtcgaggggcagcgggaggaaagcttgctttccttgccggcgaccggcgcacgggtgcgtaacgcgtatcgaacctggcccatacacggggatagtctcctgaaagggaggttaatacccggcggtcccacttggtcgcatgactgtgtgggtgaagattcatcggtatgggatggcggtgcgtaggattagctagtcggcggggtaacggcccaccgagccatcgatcagtaggggttctgagaggaaggtcccccacattggtactgagacacggaccaaactcctacgggaggcagcagtgaggaatattggtcaatgggcgcgagcctgaaccagccaagtagcgtgagggaagactgccttatgggttgtaaacctcttttgttagggagcaaccggtggcactagtgccattctgcgagtacctttcgaat

SEQ ID NO: 4902 - DNA, 490 bp, Unknown
  Ascusbbf_816599, encodes 16S rRNA
agagtttgatcctggctcaggacgaacgctggcggcgtgcttcatacatgcaagtcgaacgagaaatttacttcggtaaatggaaagtggcggacgggtgagtaaaatgtagagaatctgccctagagagggggacaacagagggaaacttctgctaataccccatatgagcgtagctgagatgctattcttgaaaactccggtgctctgggatgagtctgcatctgattagctagttggtggggtaacggcctaccaaggcgacgatcagtagccggtctgagaggatgaacggccacattgggactgagacacggcccagactcctacgggaggcagcagtggggaatcttccgcaatgggcgaaagcctgacggagcaacgccgcgtgagtgaagaaggctttcgggttgtaaagctctgttatagaggacgaaggaagtgacggtactctataaggaagccccggctaactacgtgccagcagccg

SEQ ID NO: 4903 - DNA, 490 bp, Unknown
  Ascusbbf_846476, encodes 16S rRNA
agagtttgatcatgctcaggatgaacgctagctacaggcttaacacatgcaagtcgaggggcatcacgggtcttgcttgcaagacctggtggcgaccggcgcacgggtgagtaacgcgtatccaacctgcccccgggacgggcacagcccggtgaaaaccggattaatgcccgatagggtcacaatagggcatctgagtgtgaccaaaggccttttggcgcccgcggatggggatgcgtctgattaggtagtaggcggggcaacggcccacctagccgtcgatcagtaggggttctgagaggaaggtcccccacattggtactgagacacggaccaaactcctacgggaggcagcagtgaggaatattggtcaatgggcgcaagcctgaaccagccaagtagcgtgcaggatgactgccctatgggttgtaaactgcttttatacggggataaagtcagagtcgtgactctgtttgcaggtaccgtatga

SEQ ID NO: 4904 - DNA, 474 bp, Unknown
  Ascusbbf_1487790, encodes 16S rRNA
agagtttgatcctggctcaggatgaacgctggcggcgtgcttaatacatgcaagtcgagcggtaacacttcgggtgacgagcggcggacggctgagtaacacgtaggaacgtaccccaaactgagggataactgctcgaaagagtagctaataccacatgtgatcttcggattaaagcttcggcggtttgggaacggcctgcgcatgattagcttgttggtgaggtaacggctcaccaaggcaacgatcattagctggtctgagaggatgaccagccagactgggactgagacacggcccagactcctacgggaggcagcagtagggaattttccacaatggacgaaagtctgatggagcaacgccgcgtgcaggatgaaggctctagggtcgtaaactgcttttataggtgaagattatgacggtaacctatgaataaggatcggctaactccgtgccagcagccgcggtaat

SEQ ID NO: 4905 - DNA, 490 bp, Unknown
  Ascusbbf_1488771, encodes 16S rRNA
agagtttgatcatggctcaggacgaacgctggcggtgtgcctcatacatgcaagtcgaacgagaatcgagagcttgctctcgaggaaagtggcggacgggtgagtacaacataggaaatctgccctaaagcgggggacaacagagggaaactcctgctaataccccatatgagcttggttgaaataccaatcttgaaagatttatcactttaggatgagcctgtgcctgattagctagttggtggtgtaatggactaccaaggcgacgatcagtagctggtttgagaggatgatcagccacaatgggactgagacacggcccatactcctacgggaggcagcagtagggaattttgcgcaatgggggaaaccctgacgcagcaacaccgcgtgaatgttaagcccttcggggtgtaaagttctgtcagtagggaagaacaaatgactgtacctacaaaggaagcaccggctaactccgtgccagcagccg

SEQ ID NO: 4906 - DNA, 490 bp, Unknown
  Ascusbbf_1896162, encodes 16S rRNA
agagtttgatcctggctcaggatgaacgctagctacaggcttaacacatgcaagtcgaggggcagcatgacgatagcttgctattgtcgatggcgaccggcgcacgggtgagtaacgcgtatccaaccttcccgttgctaggggataaccttgcgaaagtaagactaataccctatgaggttcttcgcaggcatctaaagagaacgaaagatttatcggcaacggatggggatgcgtctgattagctagttggtgaggtaacggctcaccaaggcgacgatcagtagccgacctgagagggtgaacggccacattgggactgagacacggcccaaactcctacgggaggcagcagtgaggaatattggtcaatgggcgagagcctgaaccagccaagtagcgtgcgggacgaaggccctatgggttgtaaaccgcttttacggggggataaagtcgggaacgtgttcccgtttgtaggtactagatgaat

SEQ ID NO: 4907 - DNA, 175 bp, Unknown
  Ascusbbf_1582666, encodes 16S rRNA
agagtttgatcctggctcaggatgaacgctggcggcgtgcttaacacatgcaagtcgcaaaaagtgaaacattatccatcacctttgtatttacaccatagtttcctgccgtcatgcggtaatatgtgtttgaactgcttgttatctttgcagtctggccagcagccgcggtaat

SEQ ID NO: 4908 - DNA, 484 bp, Unknown
  Ascusbbf_1583665, encodes 16S rRNA
agagtttgatcctggctcagaacgaacgctggcggcaggcttaacacatgcaagtcgagcgcgcccttcgaggtgagcggcggacgggtgagtaacgcgtgggaacgtgcccctttcttcggaatagcctcgggaaactgggagtaatgccggatacgcccttttggagtgatccatttggggaaagatttatcggagagggatcggcccgcgttggattaggtagttggtggggtaatggcctaccaagccgacgatccatagctggtttgagaggatgatcagccacactgggactgagacacggcccagactcctacgggaggcagcagtggggaatcttggacaatgggggcaaccctgatccagccatgccgcgtgatcgatgaaggccttagggttgtaaagatctttcagctgggaagataatgacggtaccagcagaagaagccccggctaactccgtgccagcagccgcggtaat

SEQ ID NO: 4909 - DNA, 490 bp, Unknown
  Ascusbbf_1346565, encodes 16S rRNA
agagtttgatcatggctcaggacgaacgctggcggcgggcttaacacatgcaagtcgaacggtaaggccgcttcgggggtacacgagtggcgaacgggtgaggaacacgggaggaacctgcccgggactctgggataagcagtcgaaagggtggcgaagactggataggacctgtgactgcatggtggtgggtggaaaggattttgcggggctgggaggggctcgcggccgatcagcttgttggtggggtgagggccgaccaaggcgtcgacgggtagccggcctgagagggcgaccggccccactgggcctgcggtacggccccgactcctacgggaggcagcagtggcgaatcttgcgctctgcgcggacgcctgccgcagcaacgccgcgtgcgggctgacggccttcgggttgtccaccgctttccgcagggacgacgattttttgacggtacctgcagaagaagcaccggcccactacgtgccag

SEQ ID NO: 4910 - DNA, 490 bp, Unknown
  Ascusbbf_1378644, encodes 16S rRNA
agagtttgatcatggctcaggacgaacgctggcggcgtgcttaacacatgcaagtcgaacggtaaggcctcttcgggggtacacgagtggcgaacgggggaggaacacgtgagtaacctgccctggactctgggataagcagtcgaaagggtggcgaagactggataggacctgtgactgcatggtggtgggtggaaaggatttttctggtctgggaggggctcgcggccgatcagcttgttggtggggtgatggccgaccaaggcggcgacgggtagccggcctgagggggcgaccggccacactgggactgcggtccggccccgactcctccgcgaggcagcagtggggactattgcgccatgggcggaagcctgccgcagcaacgccgcgtgcgggatgacggccttcgggttgtccaccgctttcagcagggacgacgattttttgacggtacctgcagaagaagcaccggccaactacgtgccag

SEQ ID NO: 4911 - DNA, 486 bp, Unknown
  Ascusbbf_1346561, encodes 16S rRNA
agagtttgatcctggctcagaacgaacgctggcggcaggtcttaggcatgcaagtcgaacggacgacagagtggcttgccattctgaagttagtggcgcacgagtgagtaacgcgtgggaaactgcccttcactggggaataacgtctggaaacggacgctaataccgcatacgcccgcaagggaaacgatttatcggtgatggatgtgcccgcgttggattagcgtgttggtggggtaatggcctaccaaggcgatgatccatagctggtctgagaggacgatcagccacgctggaactgagacacggaccagagacctacgtggggcagcagctaagagtatggggcaatggaggaaagtctaggacagagatgccgcgtgaatgaagaaggccttctggtagtaaagttctggtagtcatgaggatgttgacagtagtgaaagaaaaagcaccggctaactccgtgccagcagccgcggtaat

SEQ ID NO: 4912 - DNA, 490 bp, Unknown
  Ascusbbf_1444368, encodes 16S rRNA
agagtttgatcctggctcaggatgaacgctagcggcaggcttaacacatgcaagtcgaggggtaacgcgaggtagcaatactctggcgacgaccggcgcacgggtgcgtaacgcgtatgcaacctacctgtaacaggtgtataacggagagaaatttccactaatccaccatattgttattctttcgcatgttaggataacgaaagcttcggtggttacggatgggcatgcgtgacagtagctagttggtaagggaacggcttacaaaggcgacgatgtctaggggagcggtgaggctgtagccccataccgggcatggcaaagcggaccagactcctccgggaggcagaagtgatgaatgttgttaaatggacgaaagtctgaaccagccatgccgcgtggaggaagaaggtcctatgggttgtaaactccttttgttcgagagtaataagaggcttgcgagcctcgatgagagtatcggacgaataag

SEQ ID NO: 4913 - DNA, 490 bp, Unknown
  Ascusbbf_1346564, encodes 16S rRNA
agagtttgatcatggctcaggacgaacgctggcggcgtgcttaacacatgcaagtcgaacggtaaggcctcttcgggggtacacgagtggcgaacgggggagtaacacgtgagtaacctgccctggactctgggataagcagtcgaaagggtgtcgaagactggataggacctgtgactgcatggtggtgggtggaaaggatttctctggtctgggaggggctcgcggcctatcagcttgttggtggggtgatggccgaccaaggcgtcgacgggtagccggccggagagggcgaccggccccacttggactggggtccggccccgcctcctacgggcggcagcagtggggaatattgcgccatgtgcggacgcctgccgccgcaccgccgcgtgcgggatgacggccttcgggttgtacaccgctttcagcagggacgacgattttttgacggtacctgcagaagaagcaccggcccactccgtgccag

SEQ ID NO: 4914 - DNA, 490 bp, Unknown
  Ascusbbf_1378643, encodes 16S rRNA
agagtttgatcatggctcaggatgaacgctagcggcaggcttcacacatgcaagtcgaggggtaacgcggggtagcaatactctggcgacgcccggcgcacgggtgcgtaacgcgtatgcaacctacctgtaacaggggtataacggagagaaatttccactaatcccccatattgttagagattcgcatgtttctctaacgaaagcttcggtggttacggatgagcatgcgtgacattagctagttggtaaggtaacggcttaccaaggcgacgatgtctaggggagctgagaggcttatacccaaagtgggtaatgagacacggaccagaatcctacggggggcagcagtgaggaagattggtcaatggacggaagactgaacaagccatgccgcgtggaggaagaaggacctatgggttgtaaactccttgtgttcgagagtaataagaggcttgcgagcctcgaggagagtatcggacgaataagc

SEQ ID NO: 4915 - DNA, 490 bp, Unknown
  Ascusbbf_1346478, encodes 16S rRNA
agagtttgatcctggctcaggatgaacgctagcgacaggcttaacacatgcaagtcgtggggcagcatgatcgaagctggctttgattgatggcgaccggcgcacgggtgagtaacgcgtatccaaccttccctatactagaggatagcccggcgaaagtcggattaatacgctatgttgtattgagatgatgtgtgaagaataggaaagattcatcggtataggatggggaggcgtctgattaggttggtggcggggtaacgccacaccaagcccacgatgagtaggggttatgagaggaaggtccaccagaatggaactgaacaccgaaccaaacacctcagggaggaagcagtgagaaatattggtcaatgaaacacagtcgcagccagccaagtagcgtgcagaatgccggcccgttgggttgtaaactgcttttatatagggataaagtcggagacgtgtccccgtttgtaggtactatatgaat

SEQ ID NO: 4916 - DNA, 490 bp, Unknown
  Ascusbbf_1378681, encodes 16S rRNA
agagtttgatcctggctcaggatgaacgctagcggcaggcttaacacatgcaagtcgaggggcagcgcggggtagcaatcctctggcggcgaccggcgggggggtgcgtaacgcgtgagcaacttgcccgtcactggggggtaggcactgggaacggtgtgtaattctccctaacatatggattcacatggattcatattgaaagattcgttggtgacggatgggctcgcgtaacataagctagttggcggggtaacggcccaccgaggctacgatgtttaggggttctgagaggaaggtcccacacgatgggactgagggacgggccagattcctacggcaggaagcagtaaggaatattggtcaatgagcggaagcctgaaccagccatgccgcgtggaggaagaaggccctatgggttgtaaactccttttgttcgagagtaataagggctttgagaagcccgatgagagtagcggacgaataagca

SEQ ID NO: 4917 - DNA, 490 bp, Unknown
  Ascusbbf_1444658, encodes 16S rRNA
agagtttgatcctggctcaggataaacgctggcggcgcacataagacatgcaagtcgaacgaacttaatcgaaagtttacttttgaagcggttagtggcggactggtgagtaacgcgtaagcaatctgcctatcagaggggaataacagtgagaaatcattgctaataccgcataagctgtgagtatcgcatactacaactagaaaaggagcactccgctgatagatgagcttgggtctgattagttaggtggtggggtaccggcctaccaagacgaggatcagtagccggactgagaggtaaaacggcaacattgggactgaggtacggcccagaaacctacggagagcagcaggcgggaatatggcgaaatggaggaaactctgaggcagagacgccgcgggcaggaagaaggtttgcggattgtaaactgctttagatagggaagaaaaaaaatgacggtacctatagaataagcaccggctaacta

SEQ ID NO: 4918 - DNA, 486 bp, Unknown
  Ascusbbf_1444326, encodes 16S rRNA
agagtttgatcctggctcagaacgaacgctggcggcaggtcttaggcatgcaagtcgaacggacgccagagtggcttgccattctgaagttagtggcgcacgagtgagtaacgcgtgggaaactgcccttcactggggaataacgtctggaaacggacgctaattccgcatacgcccgccaggggaaagaattatcggtgatggatgtgcccgcgttggattagcttgttcgtggggtaatggcctagcaaggcgatgatccatagctggtctgagaggacgatcagccaccctggaactgaggaacggtccagactcctacggggggcagcagcgaagaatattgggcaatggcggaaactctgacccagccatgccgcgggaatgaagaaggccttcggggtgtaaagttcttgtagtcatgaagatgatgacagtagtgacagaaaaagcaccggctaacttcgtgccagcagccgcggtaat

SEQ ID NO: 4919 - DNA, 490 bp, Unknown
  Ascusbbf_1378669, encodes 16S rRNA
agagtttgatcctggctcaggatgaacgctggcggcgtgcctaatacatgcaagtcgaacgaggtttctcttcggggaaaccgagtggcgaacgggtgagtaacacatagttaatctacctttcagaatgggatacccaagagaaattttggctaataccgtatacaatcatttctccgcttggagatttgatgaaaggggctccaaagcctcgctgttagcttaacctgtggcacattggctagttggtgatataacagcccaccaaggcgaagaggtgtagccgatctgaaaggaaaatcaggcaaattggatcttggacccggcccatactcccacggtaggcagcagtagggagctttcggcaatgggggaaaccctgaccgagcacagccgcgtgatttagaaggccctctgggtcgtaagaatctgttgtaaaggagaaatggtagtgggaggaaatgcccattatttgatagtactttattag

SEQ ID NO: 4920 - DNA, 490 bp, Unknown
  Ascusbbf_1346524, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttagagattcgcatgtttctctaacgaaagcttcggtggttacggatggacatgcgggactttggcaagttggtaaggtaacgacttaccaaggcgacgatgtctaggggagctgggaggcttatcccccacacaggtagtgagacacggaccaaactcctgcgggaggcgtcagtgaggaagattagtcaatggacggaagtctgaaccagccatgccgtgtggaggaagaaggtcctatgggttgtaaactccttttgttcgagagtaataagaggcttgcgagcctcgatgagagtatcggacgaataagc

SEQ ID NO: 4921 - DNA, 490 bp, Unknown
  Ascusbbf_1378945, encodes 16S rRNA
agagtttgatcctggctcagaacgaacgctggcggcaggcttaacacatgcaagttggacgggaatcgattgatagcttgctattgcttgaggagagtagcgcacgggtgagtaacacgtgggaacataccgtatagtgggggataacaattggaaacgattgataataccgcataagtcctaagggagaaaggagtaattcgctataagattggcccgcggaagattaggcagtgggtggggtaaaggcctaccaaacctacgatctatagctggtctgcgaggacgatcagccacattgggcctgtgcctcggccccaactcctacgggcggccgccgtggggactcttgggcactgggggcacccctgccccggccctgccgcgtgagtgaagccggttttcgacttgtaaagctctttcggatgtgaagctgatgacggtagcctctcaagacgccccggcaaccttcgtgccagcagccgcggta

SEQ ID NO: 4922 - DNA, 490 bp, Unknown
  Ascusbbf_1346843, encodes 16S rRNA
agagtttgatcatggctcaggataaacgctggcggcgtacataagacatgcaagtcgaacggccgcaatcaatagtttactattgttgcggttagtggcggactggtgagtaacacgtatgtaacctgcctatcagaggggaacaacagctagaaatgactgcgaagaccgcatatgccataactagcgcatgacagaagtgggaaaggagcaatccgctgagagatggacttgcgtctgattagatagttggtggggtaacggcccaccaagtcgacgatcagtagccggactgagagggtaaccggccacgttgggcctgcgtgacggcccggactcctacgggcggcagccgtcgggactattgcgcactggcggaaactctgacgcagtgccgccgcgtgcagggagaaggttttcggattgtaaactgctttagacagggaagaaacacgacagtacctgtagaataagctccggctaactacgt

SEQ ID NO: 4923 - DNA, 490 bp, Unknown
  Ascusbbf_1444314, encodes 16S rRNA
agagtttgatcatggctcaggatgaacgctagcgacaggcctaacacatgcaagtcgaggggcagcgcgggagaagcttgcttttcctggcggcgaccggcgcacgtgtgcgtaacaggtgtgcaatctttccatcgtcggggaatagcccagcgaaagttggattactgctccatgtttcacgaagccgcatgactttgtgatgaaacgtaattcctctggttgagcacgcttctgcgtagatagttggtgagttaacgtctcaccaagtctactatcagtcggggttctgcgagaaaggccccacaactaggaactgggaaacggtccaaacgcctacgggaggcagccgtgaggaagattggtcaatgggcgagagcctgaaccagccaagtagcgtgaaggatgaaggttctatggattgtaaacttcttttgtccgagggtaaaaaaggccacgtgtggctgcttgcaagtatcggacgaataag

SEQ ID NO: 4924 - DNA, 486 bp, Unknown
  Ascusbbf_1378986, encodes 16S rRNA
agagtttgatcctggctcagaacgaacgctggcggcaggtcttagacatgcaagtcgaacggccgccagactggcttgcccttctgatgttagtggcccacgagtgcgtaacgcgcgggtaactgcccttcactggggtataacgtctggaaacggacgccactaccgcatacgcccgcttcgggtacggtgtctcggttgtggatctgccggcgttgggttagcttgttggtggggtaattgccttcctaggcggtgatccctggctggtctgagacgacgagcaggcactatggaactgggacacggtccagactccgacgggaggcagcagctaagaatattgggcaacggaggagactccgacccagccatgccgcgtgaaggaagaaggccttcgggtgggaaagtgcgtggagtcaggaagatgatgacagtagtgaaagaaaaagcaccggctaactgcgtgccagcagccgcggtaat

SEQ ID NO: 4925 - DNA, 490 bp, Unknown
  Ascusbbf_1444318, encodes 16S rRNA
agagtttgatcatggctcaggataaacgctggcggcgtacataagacatgcaagtcgaacggtcccattctatcgcttacttttttttcgtttagtcgcggacccgtgagtaacacgtatgtaacctgcctatcagagtggaacaccagctagaaattacttccatgaccgcatatgccataactatcgcatgacagaagtgggaaaggagcaatccgctgatagatggacttgcgtctgattagatagttggtggggtaacggcctaccaattcgacgatcagtagccggactgagagggtcatcagcgacattgggactgatatccggcccaggctcctacggggggcagcagtcgggactattgcgcaatggaggaaactctgacgcagtgccgccgcgtgcaggcagaaggttttcggattgtaaactgctttagacaggggagaaacacgacggtacctgtagaataagctccggctaactacgt

SEQ ID NO: 4926 - DNA, 486 bp, Unknown
  Ascusbbf_1444366, encodes 16S rRNA
agagtttgatcctggctcagaacgaacgctggctgcaggccttaggcatgcaagtcgaacggccgccagagttgcttgcccttctgtagttagtggcgcacgagcgagtaactcgtgcgtaaccgcccttcactgtggtataacgtctggcaacggacgctaataccgcacacgaccgcatggggtacgatttagagtgtgtggttgtgcacaggtcggtttagcttgttggtggggcaatggcataccatggcgatgatacatagctgacctgagaggatgatcagccacgctggaactacgacacggtccagactcctacggtaggcagcagctaagaatattgggcaatggaggaaactctgacccagccatgccgcgtgaatgaagaaggccttcgggttgtaaagttcttttagtcatgaagatgatgacagtagcgacagaaaaagcaccggctaacttcgtgccagcagccgcggtaat

SEQ ID NO: 4927 - DNA, 282 bp, Unknown
  Ascusbbf_1346528, encodes 16S rRNA
agagtttgatcatggctcaggatgaacgctagctacaggcttaacacatgcaagtcgcgcagcatcatggcatgtagcaatacatgctgatggcgaccggcggatgggtgtgtgacgcgtagccaacctggccctatctcgaacacagcacctcgaaagagggattacggccctatgttccctaaactcctcatgttagcgagcaaacggtggcacttgtgccattcagggagtacctttcgattaagcatcggccaacgccgcggcagcacgcgcggtaat

SEQ ID NO: 4928 - DNA, 486 bp, Unknown
  Ascusbbf_1318961, encodes 16S rRNA
agagtttgatcatggctcagaacgaacgctggctgcaggtcttagacatgcaagtcgaacggacgacagagtgtcttgcccttctgatgttggtggcgcacgagtgagtgactcgcgggtaactgcccttcactggggaataacgtctggcgacggacgctaataccgcatacgccctcaaggggagatctttatcggtgatggatgtgcgcgcgttggactgggttgttggtggggtaatggccttcataggcgatgtaccatacctggtatgcgaggacgatcagccaccctggaactacgacacggtccagactcctacgggaggcagcagctaagaatatgaggcaatggaggaaactctgacccagccatgccgcgtgaatgaagaaggccttcgggttgtaaagttcttttagtcgtgaagatgatgacagtagtgacagaaaaagcaccggctaacttcgtgccagcagccgcggtaat

SEQ ID NO: 4929 - DNA, 490 bp, Unknown
  Ascusbbf_1378975, encodes 16S rRNA
agagtttgatcatggctcaggatgaacgctagcggcaggcttaacacatgcaagtcgaggggtaacgcggggtagcaatactctggcggcgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgacattagctagttggtaaggtaacggcttaccaaggcgacgatgtctaggggagctgaggggcttatcgaccacagtggtactgagacacggagcgaactgagagagggggcagcagcgaggaatatgggtcagtggacagaagtctgaaccagccatgcggcgtggaggaagaaggcccgaggggttgtaaactccttttgttcgagagtaataagggcgtggcgaagccagatgagagtatcggacgaataagc

SEQ ID NO: 4930 - DNA, 490 bp, Unknown
  Ascusbbf_1346456, encodes 16S rRNA
agagtttgatcctggctcaggacgaacgctggcggcgtgcttaacacatgcaagtcgaacggagtgcttctgtaggaggattcgtccaacggaaggagtaacttagtggcggactggtgagtaacgcgtgaggaacatgcctttcagagggggacaacagttggaaacgactgctaataccgcatgatgcatgaccggggcattccggacatgccaaagatttatggctgaaagatggcctcgcgtctgattagatagttggtggggtaacggcccaccaagtcgacggtcagtggcaggactgggaggggaacggggcacaatgggactgagagacgggccagactcctacgggagggagaagtggggaatattgggcgatagacgcaagtctgacccagcgacgcggcgtgaaggaagaaggctttcgggtggtaaacgtcttttaagggggaaggggtgaagacggtaccccttgaataagcaacgg

SEQ ID NO: 4931 - DNA, 490 bp, Unknown
  Ascusbbf_1378757, encodes 16S rRNA
agagtttgatcatggctcaggatgaacgctagcgacaggcctaacacatgcaagtcgaggggcagcgcgggagaagcttgcttttcctggcggcgaccggcgcacgggtgcgtaacaggtgtgcaatctgtccatagtcggggaatagcccagcgaaagttggattaatgctccatgtgaatcgagaccgcatgatcttgatttgaaacgtaaggactatgggtgagcacgcttctgattagctcgttggcggggcaacggcccaccacgacgacgatcggtagccggcctgatgggttggaccgcaacagtgagaagaagagacggcacggactccgacgggaggcagaggtagggaatattgaacgatgggggaaaccctgatgcagcaacgccacgtgtgggaagaagcatttcggtgtgtaaaccactgtcgtgagggaataaggcattgtttcggcgatgttgaatgtacctcgagaggaagcac

SEQ ID NO: 4932 - DNA, 490 bp, Unknown
  Ascusbbf_1346598, encodes 16S rRNA
agagtttgatcctggctcaggacgaacgctggcggcgtgcttaacacatgcaagtcgaacgatgatgaccggagcttgctttggttggattagcggcgaacgagtgagtaacacgtgagtaacctgcccccttcttcgggataaccactggaaacggtggctaatattgggtatgacatcagatcgcatggattggtgtggaaaggttttttctggtgggggatgggaacgcggtctatcagctggttggtggggggatggcctaccaaggtctgatgggtagccggcctgagcgggcgaccggccaagctgggactgggacacggcccagactcctacgggaggcagcagtcgggaatattgcacaatgggggaaaccctgatgcagcgacgccgcgtgggggatgaaggccttcgggttgtaaacccctttcagtaaggaacaaggccatgattgttgttgtggttgagggtacttgcagaagaagcg

SEQ ID NO: 4933 - DNA, 486 bp, Unknown
  Ascusbbf_1444536, encodes 16S rRNA
agagtttgatcctggctcagaacgaacgctggcggcaggccttaggcatgcaagtcgaacggacgacagagtggcttgccattctgaagttagtggcgcacgcgtgagtaacgcgtgggaaactgcccttcactggggaataacgtctggcgacggacgctaataccgcatacacccgcaaggggaaagatttatcggtgatggatgtgcccgcgttggattagctggttggtggggtaatggcctaccaaggcgaggatccatagctggtctgagaggacgatcagccacgctggaactgagacacggtccagactcctacgagaggcggcagcaacgaatagtgggcaatggaggaaactctgacccggccatgccgcgtgaaggaagaaggccttcgggtcgtaaagttcttttagtcatgaagatgatgacagtagtgacagaaaaagcaccggctaactccgtgccagcagccgcggtaat

SEQ ID NO: 4934 - DNA, 490 bp, Unknown
  Ascusbbf_1346675, encodes 16S rRNA
agagtttgatcctggctcaggataaacgctggcggcgcacataagacatgcaagtgaacggacttaactcattcttaacgattgagagcgtttagtggcggacttgtgagtaatttataagtaacctgcctatcagaggggaacaacagttggaaacgactgctaataccgcatatgccacgagaatcacatggttcaagtgggaaaggagcaatccgctgatagatggccttatatctgattagctagttggtggggtaacggcctaccaaggcgacgatcagtagccggactgagccgttaaacggcaacattgggactgagaaacggcccagactccaccgggaggcagcagtcggaaatatggagaaagggaggaaactctgaggaagtgacgccgcggggaggaagaaggttttcggactgtaaactgctttagacagggaagaaaaaagacagtacctgtagaataagctccggctaactacgt

SEQ ID NO: 4935 - DNA, 490 bp, Unknown
  Ascusbbf_1346590, encodes 16S rRNA
agagtttgatcatggctcaggacgaacgctggcggcgtgcttaacacatgcaagtcgaacgctgaagctcccagcttgctgggggtggatgagtggcgaacgagtgagtaacacgtgagtaacctgcccctgactctgggataagcactagaaatggtgtctaatactggatatatctcatggccgcatggtcggtgagtggaaagatttatcggttggggatggactcgcggcctatcagctagatggtgaggtactggctcaccatgtcgacgactggtagccggcctaggagggtgaccggcaacactgggacggggacacggcccagactcctacgggaggcagcagtggggaatattgcacaatggacgcaagcctgatgcagcaacgccgcgggagggatgacggccttcgggttgtaaacctatgttagtagggaagaagcgaaagtgacggtacctgcagaaaaagcaccggctaactacgt

SEQ ID NO: 4936 - DNA, 490 bp, Unknown
  Ascusbbf_1378722, encodes 16S rRNA
agagtttgatcctggctcaggacgaacgctggcggcatgcttcacacatgcaagtcgaacggactgcttccttcgggcttacagttcgtggcgaacgggtgagtaatgtatgagccacctgcctctatcaacggtctaacagttggaaacgcctgctattacggtctaagaccacggcaccgcatgattctgcggtaaaatatttttcggatatcgatgggctcatatccccttagctggttggtgggaaaaccgcccaccaaggcgacgatgggtagccgagctgacaggctgctcggcaacattgggacggaaacacggcccagactccgacgggaggcagcagtggggaatagtgggcaatggaggcaacgctgacccagcaatgccgcgtgagtgaggaaggtaattttagtgtaaagctcttttcgcaggaacgaataaagatgacggtacctgaggaataagccccggctaactacgtggcagc

SEQ ID NO: 4937 - DNA, 490 bp, Unknown
  Ascusbbf_1444554, encodes 16S rRNA
agagtttgatcctggctcaggacgaacgctggcggcatgcttaacacatgcaagtcgaacggactgattccttcgggctgatagtttgtggcgaacgggtgagtaatgtatgagcaacctgcctctatcaacgggataacagttagaaacgactgctaatacggtataagaccacggcaccgcatgatgctgcggtaaaagatttttcggatagagatgggctcatatcccattagctagttggtgagataacagcccaccaaggcgacgatgggtagccgagctgagaggatgatcggccaaaaagggaactgaacaacggcccgagagctacgggaggcagcagtggggaatattgggcaatggaggcaactctgacccagcaatgccgcgtgagtgaggaaggtaattttatggtaaagcgctcttctcaggaaggaataaagatgacggtaccggaggaagaagccccggctaactacgtgccagc

SEQ ID NO: 4938 - DNA, 490 bp, Unknown
  Ascusbbf_1378726, encodes 16S rRNA
agagtttgatcatggctcaggatgaacgctagcggcaggcttaacacatgcaagtcgaggggcagcgcggggtagcaatactctggcggcgaccggcggaagggggcgtaccgcgtgagcaacgtgcccgtcactgggggagaggcactggaaacggtgtgtaatactccataccatatgtcttcacatggattcatattgcaagattcgttggttacggatgggctcgcgtaacattcgccagtcggcggggtaacggcccacccaggcgacgatgtttaggggttctgcgaggaaggtcaccagcgctgacactggacaacggtccagattcctacgggaggcagcagtgaggaatattggtcaatgggcggaagcctgaaccagccatgccgcgtgaaggaataaggccctatgggtcggaaactgcttttccttgagggaaataagggtaacgtgtggcccgatgagagtatcaggggaataagca

SEQ ID NO: 4939 - DNA, 490 bp, Unknown
  Ascusbbf_1444562, encodes 16S rRNA
agagttgatcatggctcaggatgaacgctgacggcgtggttaacacaggcaagtagaacggagggagcgcgcggaggagagcttgctcaaagcgggagagaacggagtggcggacgggtgaggaacgcgtggataacctgccggatacggggggagaacactgagaaataggttctaataccgcataagcgcacgttcccgcatgggaaagtgtgaaaaacgccggtggcgtaagatggatccgcgtctgattagatagttggtggggtaacggcccacaaagccaacgatcagtagccggcctgcgagggggcacggccacagtgggactgcgacacggccccgactcctacgggaggcagcagtggggcatcttgcacaatgggggaaaccaggatgcagcgacgccgcgtgagtgaagcagtatttcggtatgtaaagctctatcagcaaggaagaaaaaaatgacggtacttgactaagacgcccc

SEQ ID NO: 4940 - DNA, 490 bp, Unknown
  Ascusbbf_1444549, encodes 16S rRNA
agagtttgatcctggctcaggacgaacgctggcggcgtgcttaacacatgcaagtcgaacgggagtatcaaagaagcttgcttttatgatactttagtggcggacgggtgagtaacgcgtgaggagctgtcctatgcagggggacaacagttggaaacggctgctaataccccataagccgagaggtaaaaggttttgtccggcaaaggaggcactcgcgtcctatcagctagtgggttgggtaacggccgacctaggcgaagacgggtagccggcctgagagggcgaacggccacactggaacggagagacggtgcagactccgacgggagggagaagtggggaatattgggcaatgggggcaaccctgagcgagcgacgcggcgtgggtgaagaaatccttcgggatgtaaagcgctgttgtaggggaagagtagaagacggtaccatacgaggaagccccggcaaactacgtgccagcagccgcggt

SEQ ID NO: 4941 - DNA, 490 bp, Unknown
  Ascusbbf_1346603, encodes 16S rRNA
agagtttgatcctggctcaggatgaacgctagcggcgtgcctaacacattcaagtcgaacggagatatactgaagcttgcttttgtctattttagtggcggacgggtgagtaatgcatgagcaacctgccttaacgagtgggataacacagagaaatttgtgctaataccgcataagctgcgaaggagtcctctcccattcagaaaaggagcaatccgctttaagatggtctcatgtctgattctatagtttgtagggtaacggcctaccaagccggcgatcattagccggactgagaggtagaacggacaacacggaacagagctacggtccagactcgtacgggaggcagaagtggggaatattgggcaaggggcgaaagcctgacccagcaacgccgcgtgaaggaagaaggtcttcggattgtaaactgcgtggacaggggacgaagcatgacggtaccctgaaaacaagccacgactaactacgt

SEQ ID NO: 4942 - DNA, 486 bp, Unknown
  Ascusbbf_1444624, encodes 16S rRNA
agagtttgatcctggctcagaacgaacgctggcggcagggctgaggcatgcaagtcgaacggacgacagagtggcgtgccattctgaagttaggggcgcacgggtgagtaacgcgtgggaaacggcccttcactggggaataacgtcgggaaacggacgctaagaccgcatacgcccgcaaggggaaagagttatcggtgatggatgtgcccgcgtgggagtagcgtgttggtgggggaatggcctacaaaggcgaggagccatagctggtctgagaggacgatcagccacgctggaacggcgacccggtcccgactcctacgggcggcagccgctcagactcttgggcactggcggaccctctgcccccgccctgccgcgtgaatgaagacggccttcgggttgtatagttcttttagtcatgaagctgatgcccgtagtgacagaacaagcaccggctaacttcgtgccagcagccgcggtaat

SEQ ID NO: 4943 - DNA, 486 bp, Unknown
  Ascusbbf_1444625, encodes 16S rRNA
agagtttgatcatggctcagaacgaacgctggcggcagggctgaggcatgcaagtcgaacggacgacagagtggcgtgccattctgaaggtaggggcgcacgggtgagtaacgcgggggaaacggcccttcactggggaataacgtcgggaaacggacgcgaagaccgcagacgcccgcaaggggaaagaggtagcggtgacggatgggcccgcgtgggagtagcgtgtggggggggtaatggcctaccaaggcgatgtgccagagctggtctgagaggacgatcagccacgctggaactgcgccccggtcccgactcctccgggcggcggccgctccgcctcttggccactggcggaccctctgcccccgccctgccgcgtgaatgacgccggccttcgggttgtacagttcttttagtcctgacgctgatgacagtagtgacagaacacgcaccggctaccttcgtgccagcagccgcggtagt

SEQ ID NO: 4944 - DNA, 486 bp, Unknown
  Ascusbbf_1346461, encodes 16S rRNA
agagtttgatcatggctcagaacgaacgctggcggcaggtcttaggcatgcaagtcgaacggacgacagagtggcttgccattctgaagttagtggcgcacgagtgagtaacgcgtgtgaaaccgcccttccctggggaataccgtctggctacggacgctactaccgcatacgcccgccaggggaaagatttatcgttgatggatgtgcccgcgttggattagcttgttggtggggtaatggcctaccaaggcgatgatccatagctggtctgagaggacgatcagccacgctggaactgagaaacgggccagactcctacgggaggcagcagctaagaatattggacaatggaggaaactctgacgcagccatgccgcgtgaatgaagaaggccttcgggttgtaaagttcttttagtaatgaagatgatgacagtagtgacagaaaaagcaccggctaacttcgtgccagcagccgcggtaat

SEQ ID NO: 4945 - DNA, 490 bp, Unknown
  Ascusbbf_1444672, encodes 16S rRNA
agagtttgatcctggctcaggatgaacgctagctataggcttaacacatgcaagtcgcggggcatcatggcatgtagcaatacatgctgatggcgaccggcggatgggtgagtaacgcgtatccaaccttgccctatctcgggtacagcccctcgaaagagggattaatccccgatgttccctgtgatccgcatgttttccagggcaaaggcattagtcggatagggatgggagagcgttccgttatgcagtcggcggggtaacgccccaccgagactacgatggagaggggttctgagaggaaggccccccacactggtactgagacacggcccagactcctacgggaggcagcagtgaggaatattggtcaatggcggcaacgctgaaccagccaagtagcgtgaaggatgacggccctatgggttttaaacctcttttgttagggagcaacctatggcactagtgccatactgcgagtacctttcga

SEQ ID NO: 4946 - DNA, 490 bp, Unknown
  Ascusbbf_1324126, encodes 16S rRNA
agagttttatcctggctcaggatgaacgctggcggcgtgcttaacacatgcaagtcgaacggagttatctcgctgaggagagcttgcgcaaatcgtgagataagttagtggcggacgggtgagtaacgcgtggataacctgcattataccgggggataacacttagaaataggtgctaatgccgcataagcgcacgagccggcatgggaaagtgtgaaaaactccggtggtataagatggatcggcgtctgataagaaagtcggtgaggtaacggcccaccaagacaacgatcagtagccggcctgagggggtgaacgaccaccgtggaactgagacacagcccaaactcctacggggggcagcagtggtgaatattgcacaatgcgggaaaccctgatgcagcgacgccgcgtgggtgaagaagtatttcggtatgtaaagctctatcagcaaggaagaaaaaaatgacggtacttgactaagaagccc

SEQ ID NO: 4947 - DNA, 486 bp, Unknown
  Ascusbbf_1444674, encodes 16S rRNA
agagtttgatcatggctcagaacgaacgctggctgcaggtcttaggcatgcaagtcgaacggacgacagagtggcttgccattctgaagttagtggcgcacgagtgagtaacgcgtgggaaaccgcccttcactgtggaataacgtctggaaacggacgctaataccgcatacgcccgcaaggggagagatttatcgctgttggatgtgcccgcgttggattagcttgttggtggggtaatggcctaccaaggcgatgatccatagctggtctgagacgacgatcagccacgctggaactgcgacacggtccagactcgtacgggaggcagcagctaagaatattgggcaatcgaggaaagtgtgagctagccatgccgtgtgaatgaagaaggccttcgggttgtaaagttcttttagtcatgaagatgatgacagtagtgacagaaaaagcaccggctaacttcgtgccagcagccgcggtaat

SEQ ID NO: 4948 - DNA, 490 bp, Unknown
  Ascusbbf_1378771, encodes 16S rRNA
agagtttgatcatggctcaggatgaacgctagctacaggcttaacacatgcaagtcgcggggcatcatggtgtgtagcaatacacactgatggcgaccggcgaatgggtgattaacgcgtatccaacctggccctatctcgggcacagcccctcgaaagagggattaattcccgatgttcccacgagttcgcatgttcttgtgggtaaaggcctttgccggatagtgattgggatgcgttccattacgcggtcggcggggtaacggcccaccgagccttcgatggataggggttctgagagcatgccacacaacacggggaaggacgaaaggcccagactcctacgggaggcagcagtgaggaatattggtcaatggcggcaacgctgaaccagccaagtagcgtgagggattacggccctatgggttttaaacctcttttgttggggagcaacctgtgccactagtggcacactgcgagtacccttcga

SEQ ID NO: 4949 - DNA, 490 bp, Unknown
  Ascusbbf_1444691, encodes 16S rRNA
agagtttgatcctggctcaggatgaacgctagcggcaggcttaacacatgcaagtcgaggggaaacgcggggaagaaatactctggcgacgaccggcgaccgagtccgtaacgcgtatgcaccctacctgtaacaggggaatacgggagagaaatttccactaatcccccatattgttattctttcgcatgttaggttaacgaacgcttcggtggttacggatgggcatgcgtgacattagcgcgtgggtacggtaacggcttcccaaggctacgttgtctaggggggctgcgagtcttatccaccacactggtactgagacacggaccagactcctacgggaggcagcagtgaggaatattggtcaatggacggaagtctgaaccagccatgccgcgtggaggaagaaggtcctatgggttgtaaactccttttgttcgagagtaataagaggcttgcgagcctcgatgagagtatcggacgaataagc

SEQ ID NO: 4950 - DNA, 490 bp, Unknown
  Ascusbbf_1323951, encodes 16S rRNA
agagtttgatcctggctcagattgaacgctggcggaatgctttacacatgcaagtcgaacggcagcacgggagcttgctcctggtggcgagtggcgaacgggtgagtaacatatcggaacgtacctagtaatgggggataactagtcgaaagattagctaataccgcatacgccctgagggggaaagcgggggatcgtaagacctcgcgttattagagcggccgatatctgattagctagttggtggggtaaaagcctaccaaggcgacgatcagtagctggtctgagaggacgaccagccacactggaactgggacacggtccagactcctacgggaggcagcagtggggaattttggacaatgggcgcaagcctgatccagccattccgcgtgagtgaagaaggccttcgggttgtaaagcgctttcgcaagggaagaaacgatgcagtcgaataaactgcgttaatgacggtaccttgataagaagc

SEQ ID NO: 4951 - DNA, 490 bp, Unknown
  Ascusbbf_1323967, encodes 16S rRNA
agagtttgatcctggctcaggatgaacgctagcggcaggcttaacacatgcaagtcgaggggtaacgcggggtagcactactctggctacgaccggcgcacgagtgcgtaacgcgtatgcaacctccctgtgacacggatataacggagagcaattttcactaatccccaatatttttattctttcgcatattaggataactaaagcttcggtggttacggattggcatgcgtgacattagctatttggtaaggtaacggcttacccaggcgacgatgtctaggggagctgcgaggcatatcccccacactggtactgagacacggaccagactcctacgggaggcagcagtgaggaatattggtcaatggacggaagtctgaaccagccatgccgcgtggaggaagaaggtcctatgggttgtaaactccttttgttcgagggtaataagggcgatgcgaagcccgatgagagtatcggacgaataagc

SEQ ID NO: 4952 - DNA, 471 bp, Unknown
  Ascusbbf_1259286, encodes 16S rRNA
agagtttgatcatggctcagaacgaacgctggcggcatgcttaacacatgcaagtcgaacgagggcttcggccctagtggcgcacgggtgagtaacgcgtaggtatctgccttgaagtggggaataacggtggaaaactgccgctaatgccgcatacgccctgagggggaaagctttatgcgctttgagaggagcctgcgtccgattaggtagttggtggggtaacggcctaccaagcccgcgatcggtagccggtctgagaggacgatcggccacactgggactgagacacggcccagactcctacgggaggcagcagtggggaatattggacaatgggcgcaagcctgatccagcaatgccgcgtgagtgatgaaggccttcgggttgtaaagctcttttgccgatgacgatgatgacggtagtcggcgaataagccccggctaacttcgtgccagcagccgcggtaat

SEQ ID NO: 4953 - DNA, 487 bp, Unknown
  Ascusbbf_1323984, encodes 16S rRNA
agagtttgatcatggctcagaacgaacgctggcggcaggcttaacacatgcaagttgagcgggattaattgatagcttgctattgattatgagagcagcgcactggtgagtaacacgtgggcacataccttttggtgtgggacaacagttggaaacgactgctaataccgcatcagccctaagggggcagatttatttccgaaagattggcccgcggacgattaggtagtaggtggggttacgtcccacctagccgacgatctatagctggtctgagaggacgattcgccacattggaactgagacacggtccagactcctacgcgaggcagcagtgaggaatattgggcaatggaggaaactcggacccagccatgccgcgtgagtgaagaaggttttcggattgtaaagctctttcagacgggaagatgatgacggtaccgtcagaagaagcaccggctaacttcgtgccagcagccgcggtaat

SEQ ID NO: 4954 - DNA, 490 bp, Unknown
  Ascusbbf_1377277, encodes 16S rRNA
agagtttgatcatggctcaggatgaacgctagcgacaggcctaacacatgcaagtcgaggggcagcgcgggagaagcttgcttttcctggcggcgaccggcgcacgggtgcgtaacaggtgtgcaatctgtccatagtcggggaatagcccagcgaaagttggattaatgctccatgtgtcacgacgccgcatgactttgtgatgaaacgtacggactatgggtgagcacgcttccgattagatagttggtgaggtaacggctcaccaagtcgccgatcagtaggggttccgagaggaagggcacccaaatgcgaacacagacaaggtcccaacgccagcgggaaggagcagtgaggaagaatggggaaagggcgagaggccgaaccagccagttcgcgtgaaggatgaagggtctagggagtgtaaacgtctttggtccgagggtaaaaaaggccacgggtggcttcttgcaagtatcggacgaataag

SEQ ID NO: 4955 - DNA, 490 bp, Unknown
  Ascusbbf_1347057, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctacctgtaacagggggataacggagagaaatttcgactaatcccccatattgttagagattcgcatgtttctctaacgaaagcttcggtggttacggatgggcaggcgtgacattagctagttggtagggtaacggcttaccaaggcgaagatgtctaggggagctgagagtcttatcgcacacacgggtactgggacacggaccagactcctacgggaggcagcagtgaggaaaattgagcaatggacggaagtctgaaccagccatgccgcgtggaggaagaaggtgctatgggttgtaaactccttttgttcgagagtaataaggggctggcgagcctcgatgagagtatcggacgaataagc

SEQ ID NO: 4956 - DNA, 490 bp, Unknown
  Ascusbbf_1347145, encodes 16S rRNA
agagtttgatcctggctcaggatgaacgctggcggcgcgcttaacacatgcaagtcgaacggagttatctcgctgagtagagcttgctcaaatcttgagataacttagtggcggacgggggagtaacgcttggataacctgccttatactgggggataacacttataaataggtgctaataccgcataagcgcacgttcccgcaggcgaaagggtggaaaactcgcgtggtgtaagatggatcggggtcggattagatagttggcgaggtaacggcccaccaagtcaacgatcagtagccgacctgagagggggaacggcaacattgggcctcggacacgacccaaactcatacgggaggcagcggtggggaatattgcacaatgggggacaccctgatgcagcgccgccgcgtgggtgaagaagtatgtcggtatgtaaagctctatcagcaaggaagcaaaaaatgacggtacttgactaagaagccc

SEQ ID NO: 4957 - DNA, 490 bp, Unknown
  Ascusbbf_1377363, encodes 16S rRNA
agagtttgatcatggctcagagcgaacgctagcggaatgctttatacatgcaagtcgaacggattttgatctttgtcgcaatacaaagattacgattagtggcgaacgggtgagtaatagttaggaacttgccgaatagtgggggacaacagttagaaatgactgctaataccgcatactcccgagaggggctagatgttttgctattcgagaggcttaaccacgaatagcgtgttggcggggtaattgcccaccaaggcagtgatcgttagccgaccttagaggatgatcggccacattgggaccgagacacggcccagactcctacggtaggcagctgtacggaatattggacaatggacgcaagtcggatccagcaatcccgcgggagtgatgaaggtgttatgcatggtaaaactcttttgcccatgaagacaatgacggtagtgggagaataagcaccgactaactacgtgccagcagccgcggt

SEQ ID NO: 4958 - DNA, 490 bp, Unknown
  Ascusbbf_1446139, encodes 16S rRNA
agagtttgatcctggctcaggatgaacgctagctacaggcttaacacatgcaagtcgaggggtaacgtcagcgaaactttgctctttctacgcgaccagcggcgagtgggtgtgacacgcgtacaccccccgccgcaccctaggacacacccttgagacagtaagtataatgctctatcttctgtttcggggtcatgtgatttgcagaaaaggattagagctttgcgatggggatgcggttgtttaggttgttgggggggtacaggcccaccaagccgagggttagtgggggttctgagcggaagatccccaacattggaactgagacacggtccaaactcctacgggaggcagcagtgaggaatattggtcaatgggcgagagcctgaaccagccaagtagcgtgcaggacgaatgccctacgggttgtaaaccgcttttgcggaggaataaaatatgcgacgtgagaggcattgcaggtactccgcga

SEQ ID NO: 4959 - DNA, 490 bp, Unknown
  Ascusbbf_1347106, encodes 16S rRNA
agagtttgatcctggctcaggatgaacgctagcggcaggcttaacacatgcaagtcgaggggcagcgcggggtggcaatcctctggcggcgaccggcggaagggtgcgtaacgcgtgagcaacttgcccgtcactgggggataggcactggaaacggtgtgtaatactccataacatatggattcacatggatttatattgaaagactcgttggtgacggatgggctcgcgtaacattagctagtcggcggggtaacggcccaccgaggctacgatgtttaggggttctgggaggaaagtccccaaccatggaactgggagaacggtccaaaacccaacggcgggcgccagtggggaaaatgggtcaatgggcggaagcctgaacaagccatgcggcgggcaggaataaggccctatgggtcgtaaactgcttttccgtgagggaaataaggggaacgtgtggcccgatgagagtatcaggggaataagc

SEQ ID NO: 4960 - DNA, 488 bp, Unknown
  Ascusbbf_1347100, encodes 16S rRNA
agagtttgatcatggctcagaacgaacgctggcggcaggcttaacacatgcaagttgagcgggattgattgatagcttgctattgatcatgagagcagcgcactggtgagtaacacgtgggaacataccttttggtgggggacaacagttggaaacgactgctaataccgcataagccctgagggggaagattaattgccgagagattggcccgcgggagatttggtaggagggggggtgaacggcttacttgccggacgatctttggctggtctgagagaacgttcagccccattggaactgagacacggtccagactcatacgggaggcagcagtgaggaatattgggcaatggagggaactctgacccagccatgccgcgtgagtgaagaaggttttcggattgtaaagctctttcagacgggaagatgatgacggtaccgtcagaagaagcaccggctaacttcgtgccagcagccgcggtaat

SEQ ID NO: 4961 - DNA, 490 bp, Unknown
  Ascusbbf_1347115, encodes 16S rRNA
agagtttgatcctggctcaggatgaacgctagcggcaggcttaacacaagcaagtcgaggggtaacgcggggtagcaatactctggcgacgaccggcgcacgggtgcgtaacgcgtatgcaacctacctgtaacaggggtataacggagagaagtttccactaatcccccatattgggatgctggcgcaggttaggataacgaaagcttcggtggttacggatgggcatgcgtgacattagctagttggtaaggtaacggcttaccaaggcgacgatgtctaggggagctgagaggcttatccccaacactgggactgagccccccaccagactcctacgggaggcagccctccggaatattggtcaatggacggaagtctgaaccagccatgccgcgtggaggaagaaggtcctatgggttgtaaactccttttgttcgagagtaataagaggcttgcgagcctcgatgagcgtatcggacgaataagc

SEQ ID NO: 4962 - DNA, 485 bp, Unknown
  Ascusbbf_1446070, encodes 16S rRNA
agagtttgatatggctcagaacgaacgctggcggcaggtcttaggcatgcaagtcgaacggacgacagagtggcttgccattctgaagttagtggcgcacgagtgagtaacgcgtgggaaactgcccttcactggggaataacgtctggaaacgacggctaataccccatacgccggcaagggaaaagctttctcggtgagggttgggcccgcgtgggtttagcttgttggtggggtaatgtcctaccaaggcgatgatccatagcgggtctgagaggacgatcagccacgctggaactgggacacggtccagactcctacgggaggcagcagctaagaatattgggcaatggaggaaactctgacccagccatgccgcgtgaatgaagaaggccttcgggttgtaaagttcttttagtcatgaagatgatgacagtagtgacagaaaaagcaccggctaacttcgtgccagcagccgcggtaat

SEQ ID NO: 4963 - DNA, 350 bp, Unknown
  Ascusbbf_1346978, encodes 16S rRNA
agagtttgatcctggctcagaacgaacgctggcggcgaggctgaagcatgcaagtcgagcgggaggggcagcgaggccccgagagcggcggacgggggaggaacgcgcggacaaccgaccctccggcgggggagagccgagcgaaagcgcggagaacaccgcaggagacggagcgggggcggccctgcgccgggaaagcgcctgcgggcgcgccgggggacgggcgttgggcgcagcagcgtggtggcgtcgttttcgcgggggggcgcgaccgtggcagggaatgggcgcggggtgccgcggcccgaggaatacgccccggcaacctccgtgccagcagccgcggtaat

SEQ ID NO: 4964 - DNA, 490 bp, Unknown
  Ascusbbf_1377186, encodes 16S rRNA
agagtttgatcatgactcaggatgaacgctggcggcgtgcctaacacatgcaagtcgaacggaaaggattcttcggcattcttttagagggggacgggtgagtaacgcgtgggtaacctgccccatacaggggaacaacagctgtaaacggctgctaataccgcataagcgcacagtactgcatggtacagtgtgaaaagattttatcggtatgggatggacccgcgtctgattggctcgttggaggggtaacggcccaccacggcgacgctcagtcgccgacctgagagggtgaccggccacattggggctgagacacggaccaaactccgacgggaggcagaagtggtggatattgcacgatgggcggaagcctgatgcagcgacgccgcaggagtgaggaagtattgcggtatgtgaagctctatcagcagggaagaaaatgactgtacctgaataagaagccccggctaactacgtgccagcagcc

SEQ ID NO: 4965 - DNA, 490 bp, Unknown
  Ascusbbf_1377234, encodes 16S rRNA
agagtttgatcctggctcaggatgaacgctagcgataggcctaacacatgcaagtcgaggggcagcacatgaagtagcaatacggctggtggcgaccggcgcacgggtgcgtaacgcgtatgcaatctacctacaacaagggaataacccgttgaacgacggactaataccctataaaacaggggtcccgcatgggaatatttgttaaagatttatcggttgtatatgagcatgcgttccattagcttgttggtgagataacggcccaccaaggcaacgatggatagtgtaactgagaggttgatcgcgcacactggtactgtgacacgaaccagactcctacggaaggcagaagtgaggaatattggtcaatggacgaaagtctgaaccatccacgtcgcgtgaaggaagacggccctacgggttgtaaacttcttttgtaagggaataaagtgagtcacgtgtgactttttgcatgtaccttacgaat

SEQ ID NO: 4966 - DNA, 490 bp, Unknown
  Ascusbbf_1323559, encodes 16S rRNA
agagtttgatcatggctcaggatgaacgctagcggcaggcttaacacatgcaagtcgaggggcagcgcggggtagcaatactctggcggcgaccggcgggagggtgcgtaacgcgtgagcaacttgcccgtcactgggggataggcaccggaaacggtgtgtaatactccataacatatggattcacatggatttatattgaaagattcgttggtgacggatgggctcgcgtaacattagctagtcgaaggggtaacggcccaccgaggctgagatgtttaggggttctgagaggaaggtaccacaacatgtacatgagacacggtccagactcctacgggaggcagcagtgaggaatattggtcaatgggcggaagcctgaaccagccaagcagcgtgcaggaagaaggccctatgggtcgtaaactgcttttccttgggaacaatgaggggcacgtgtggcccgatgaaagtatcaggggaataagca

SEQ ID NO: 4967 - DNA, 490 bp, Unknown
  Ascusbbf_1377160, encodes 16S rRNA
agagtttgatcatggctcaggacgaacgctggcggcgcgcttaacacatgcaagtcgaacggtgaacagcggaaagcttgcttttagctgtacatagtggcggacgggtgagtaacgcgtgaggacttgtcctgtacagggggacaactgatggaaacgtcagctaataccccataagccgtgaggtaaaaggagcgatccggtacaggagagactcgcgttctatcagttagttggtgaggtaacggctccccaaggcgaagacggatagccggactgagaggttggccggccacattggaactgggatacagtccaggcgcctgcgggaggaagcgggaaggaatattggggaatgggggagacactgacccagcgacgcggcgtgagagaagaaatcactcgggatgtaaagctctgttaggcgggaagaaggaagtgacggtaccgcacgaggaagccacggcaaactacgtgccagcagccgcgg

SEQ ID NO: 4968 - DNA, 486 bp, Unknown
  Ascusbbf_1446124, encodes 16S rRNA
agagtttgatcatggctcagaacgaacgctggcggcaggtcttaggcatgcaagtcgaacggacgacagagtggcttgccattctgaagttagtggcgcacgagtgagtaacgcgtgggaaactgcccttcactggggaataacgtctggaaacggacgctaataccgcatccgcccgccagtggcaagatttatctgtaagggctgttcccgcgttggattagctttgcgtgggggtaatggcctaccaaggcgcttatccatatcttgtctgcgaggacgatccgccacgctggaactgagacacggtccagacgcctacgggaggcagcagctaagaatattgggcaagggaggaaactctgacccagccatgccgcgtgaatgaagaaggccttcgggttgtaaagttcttttagtcatgaagatgatgacagtagtgacagaaaaagcaccggctaacttcgtgccagcagccgcggtaat

SEQ ID NO: 4969 - DNA, 490 bp, Unknown
  Ascusbbf_1347141, encodes 16S rRNA
agagtttgatcctggctcaggatgaacgctagctacaggcttaacacatgcaagtcgcggggcatcatggcatgtagcaatacatgctgatggcgaccggcggatgggtgagtaacgcgtatccaacctggccctatctcgggtacagcccctcgaaagagggattaattcccgatgttccctgggatccgcatgttttccagggcaaaggcatttgtcggatagggatggggatgcgttccattaggcagacggcggggtaacggcccacggagcctacgagggataggggttctgagaggaagggcaccaaagctgggagtgagacacggcacggactcctacggcaggcagcagtgaggaatattggtgaatggcggtaacgctgaaccagcaaagtagcgtgagggagtacggccctatgggttttaaacctcttttgttagggagcaaccggtggcactagggccattctgcgagtacctttcga

SEQ ID NO: 4970 - DNA, 490 bp, Unknown
  Ascusbbf_1377172, encodes 16S rRNA
agagtttgatcctggctcaggacgaacgctggcggcatgcttaacacatgcaagtcgaacggacggattccgtcgggatgaaagttagtggcgaacgggggaggaatgtacgagcaacctgccgctggcaacgggagaacagggggaaacgacggctaatacggtataagaccacggcaccgcatggtgcggcggtaaaagatttttcggacagagatgggctcacatccctttagcgagttggtgagataatagcccaccaaggcgacgaggggtagccgagcggagaggctgatcggccacattgggactgaaacccggcccagactcctccgggaggccgcagtcgggaatagtgggccatggaggaaccgctgacccagcaatgccgcgtgcgcgaggaaggtacttttcttgtaaagctcttttctcaggaacgaataaagatgacggtacctgaggaataagccccggctaactacgcgccagc

SEQ ID NO: 4971 - DNA, 490 bp, Unknown
  Ascusbbf_1346990, encodes 16S rRNA
agagtttgatcctggctcaggacgaacgctggcggcatgcctaacacatgcaagtcgaacggagaggaggtcgggaatcttagtggcgaacgggtgaggaacgcgtaggcaacctgccctggaggtggggacaacatcccgaaaggggggcgaataccgaatgggagcgctttcccgcatgagagagcgaggaaagatggcctctatggataagctatcgctaaaggaagggcctgcgtctgcttagcgagttggtggggtaacggcctaccaaggcgatgatcagtagccggtctgagaggtggaacggcagaattgggcctgcgcaaaggccccgacgccgacgggagcccgcaaggggggctcttccggccttggcgcaagcctgacggcgcaaagccggctgagtgctgaaggaattcgttccgtaaagctcgtttgtttatgacgaatgtgcagactgtgaataatggtttgtaatgacggtagt

SEQ ID NO: 4972 - DNA, 490 bp, Unknown
  Ascusbbf_1323627, encodes 16S rRNA
agagtttgatcatggctcaggatgaacgctggcggcgtgcttaacacatgcaagtcgaacggagttatctcgctgaggagagctttctcaaatcttgagataacttcgtggcggacgggtgcgtaccgcgtggctaacctgccttatacttggggataacacttagaaataggtgctcataccgcataagcgcccgttcccgcatgggaaagtgtgaaaaactccggtggtgtaagctggatcctcgtctgattagatagtttgtgcggtaacggcccaccaagtcaacgatcagtagccggactgtaggggtgaacggcaacagtgggactgagaaacggcccaaactcctacgggaggcagcagtggggaagagtgcaaaatgggggaaacccggatgcagcgacgccgcgtgagggaagaagtatgtcggtagggaaagctagatcagcaaggaagaaaaaaatgacggtacttgactaagaagccc

SEQ ID NO: 4973 - DNA, 490 bp, Unknown
  Ascusbbf_1377181, encodes 16S rRNA
agagtttgatcctggctcaggataaacgctggcggcgcacataagacatgcaagtcgaacggactcaacgcattcgtaacgattgagagcggttaggggcggacgggggaggaatgcataagtaacctgcctatcagaggggaaccacagctggaaacgactgctaataccgcatacgccccgatcatcacatggttcaagtgggaacggaccaatccgctaatagatggacttagatctgattgtctagttggtggggtaacggcctaccaaggcgacgatcagtagccggactgcgagggtaaacggccgaaatgggactgagatacggcccagactccgaagggaggcagcagtcgggaatagtgcgcaatggaggaaactctgacgcagtgacgccgcgtgcaggaagaaggttttcggattgtaaacggctttagacagggaagaaaaaagacggtaccgggagaataagctccggctaactacg

SEQ ID NO: 4974 - DNA, 490 bp, Unknown
  Ascusbbf_1323525, encodes 16S rRNA
agagtttgatcctggctcaggatgaacgctagcgataggcctaacacatgcaagtcgaggggcagcacatgacgtagcaatacagatggtggcgaccggcgcacgggtgagtaacacgtatgcaacctaccttcaacaggggaataacccgtcgaaagacggactaataccccataatacagggctccctcatgggaatatttgttaaagatttatcggttgaagatgggcatgcgttccattagctagttggtgaggtaacggctcaccaaggcaacgatggataggggaactgagaggtcgaacgcacacactgggaatgagacacagaacggactactacgggacgaggcagggaggaatattggtgaagggaggcagcgttgaacaagccatgtcgcatgaaggatgacggctctacgggttgtaaacttcttttttaagggaataaagttaggtacgtgtagctatttgcatgtaccttacgaat

SEQ ID NO: 4975 - DNA, 490 bp, Unknown
  Ascusbbf_1323696, encodes 16S rRNA
agagtttgatcatggctcaggacgaacgctggcggcatgcttaacacatgcaagtcgaacggacggattccgtcgggatgaaagttagtggcgaacgggggaggaatgtatgagcaacctgccgcggtcaacgggagaacagtgggaaacgacggcgaatacagtagaagaccacggcaccgcatggtgcggcggtaaaagatgtgtcggacagagaggggcgcagaccccattagctagttggtgagataatagcccaccaaggcgacgaggggtagccgagctgagagacggatcggcccccttgggactgcaccacggcccagactcctacgggcggccgcagtggggactattgggcaatggcggaaactctgaccccgcactgccgcgtgcgcgatgaaggtccttttcttgtccagctcttttctcaggaacgcataaagatgacggtacctgaggaataagccccggctaactacgtgccagc

SEQ ID NO: 4976 - DNA, 485 bp, Unknown
  Ascusbbf_1378078, encodes 16S rRNA
agagtttgatcctggctcagaacgaacgctggcggcaggtcttaggcatgcaagtcgaacggacgacagagtggcttgccattctgaagttagtggcgcacgagtgagtaacgcgtgggaaactgcccttcactgggaataacgtctggaaccggacgctaatcccgcctacgcccgcaaggggaaagatttatcggttttggatttgcccgctttggattatcttgttggtggggtaattgcctaccaatgcgatgatccatatctggtcgtagaggacgatcagccacgcgggaactgagaaacggtccagacgcctacgggaggcagcagctaagaatattgggcaatggaggaaactctgacccagccatgccgcgtgaatgaagaaggccttcgggttgtaaagttcttttagtcatgaagatgatgacagtagtgacagaaaaagcaccagctaacttcgtgccagcagccgcggtaat

SEQ ID NO: 4977 - DNA, 490 bp, Unknown
  Ascusbbf_1323700, encodes 16S rRNA
agagtttgatcctggctcaggacgaacgctggcggcgtgcttcatacatgcaagtcgaacgagaagctctagcttgctagagtggaaagtggcggacgggtgagtaatatgtaggaaatctgccctagtgagggggacaacagagagaaacttctgctaataccccatatgagcttggttgcaataccaatcttgaaaactccgttgctctaggatgagccttcatctaattcgcttgttggtggtgtaatggactaccaaggcgacgatcagtagctggtttgagaggatgatcagccaaaaggggaatgggacacggcccatactcctacgggaggcagcagtagggaatgttgcgaaatgggcgaaagcctgacgcagcaacgccgcgtgaatgatgaagcccttcggggtgtaaaattctgtcagtggggacgaattttgacggtacccacagaggaagcaccggctaactccgtgccagcagccg

SEQ ID NO: 4978 - DNA, 490 bp, Unknown
  Ascusbbf_1323725, encodes 16S rRNA
agagtttgatcatggctcaggatgaacgctagcggcaggcttaacacatgcaagtcgtacggcagcgcggggtagcaagactctgtcggcgaccgtcggaggggggcgtaacacgtgagcaactttcccggcactggggggtaggcgctggaaacgttgtgtaataccccctaatatatggactcacatggattcatattgaaagattcgttggtgacggatgggctcgcgtaacattagctagtcggcggggtaacggcccaccgaggcgacgatgtttggggggtctgagaggaaggtaccatagaatggaagtaaggaacgaaccagactcgtacgggaggaaggagggaggaagcttggtgaatgggacgaagcctcaaccagccatgctgcgtgcaggaataaggcccgatgggtcgtaaactgcttttcgtggagggcaatacgtgtaacgaggggtcagatgagagtatcaggggaataagca

SEQ ID NO: 4979 - DNA, 490 bp, Unknown
  Ascusbbf_1378048, encodes 16S rRNA
agagtttgatcctggctcaggatgaacgctagctacgggcttaacacatgcaagtcgaggggcagcataacgaaagcttgcttttgtttatggcgcccggcgcacgggtgagtaacgcgtatccaaccttccccttagtatggcatagcccggcgcaagtcggattaataccctatgttttccgttgaggacatctcaaatgggacgaagagttatcgctaagggatgtgggggcgtctgatttggttgtgtgcggggtaacggccccccacaccatcgatcagtagggggtctgagaggaaggtaccccacattggaactgagacacggaccaaactcctacgggaggcagcagtgaggaatattggtcaatgggcgagagcctgaaccagccaagtagcgtgcaggatgacggccctatgggttgtaaactgcttttgcatgggaataaagtgagggacgtgtccctttttgtgtgtaccatgagaat

SEQ ID NO: 4980 - DNA, 488 bp, Unknown
  Ascusbbf_1342112, encodes 16S rRNA
agagtttgatcctggctcagaacgaacgctggcggcaggcttaacacatgcaagttgagcgggattgattgatagcttgctattgatcatgagagcagcgcactggtgagtaacacgtgggaacataccttttggtgggggacaacagttggaaacgactgctaataccgcataagccctgagggggaaagattaattgccgagagattggcccgcggaagattaggtagtaggtggggtaacggcctacctagccgacgatctatagctggtgtgagaggacgagcagccacattggaactgagacacggtccagactcctacgggaggcagcagtgaggaatattgggcgagggagagaacgctgacccagccaggccgcgagagagaaggaggttgtcgtattgtaaagctctttcaggcgagaagatgatgacggtaccgtcagaggaagcaccggctaactacgtgccagcagccgcggtaat

SEQ ID NO: 4981 - DNA, 490 bp, Unknown
  Ascusbbf_1323690, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccccttagtagggcctagcccggcgaaagtcggattaatactctttgttttccgttgcggacatctgaggtggaatatagatttatcgctaagggttggggatgcgtgtgattcggtggttggcggggtttcggcccaccaagccatcgatcagtaggggttctgagagggaggtgccacacgttggagcatagagacggaccaaagtcctacgggaggacgaagtgcggaagattggtcaatgggcgagagcctgagccagccaagtagcgtgcaggatgccggccctatggattgtaaactgcttttgcatgggaataaagtgagagacgtgtccctttttgtatggaccatgggaat

SEQ ID NO: 4982 - DNA, 490 bp, Unknown
  Ascusbbf_1378006, encodes 16S rRNA
agagtttgatcctggctcaggatgaacgctagcggcaggcttaacacatgcaagtcgaggggcagcgcggtgtagcaatactctggcggcgaccggccgaagggcgcgtaacgcgtgagcaacttgcccgtcactgggggatgggcactggaaacggtgtgtgatactcaataacatttggattcacatggcttcatattgaaagattagttggtgaccgatgggctcgcgtaacattagctagtcggcgtggtaagggcccaacggggctacgatgtgtaggggttctgagaggaaggtcccccacactggaactgagacacggtccagactcctacgggaggcagcagtgaggaatattggtcaatgggcgaaagcctgaaccagccaagccgcgtgcaggaataaggccctatgggtcgtaaactgcttttccttgaggacaataagggtcacgtgtggcccgatgagggtatcagatgaataagga

SEQ ID NO: 4983 - DNA, 490 bp, Unknown
  Ascusbbf_1378005, encodes 16S rRNA
agagtttgatcctggctcaggataaacgctggcggcgcacataagacatgcaagtcgaacggacttaactcattcttaacgattgagagcggttagtggcggactggtgagtaatgtataagtaacctgcctatcagaggggaacaacagttggaaacgactgctaataccgcatatgccacgagaatcacatggtccaagtgggaaaggagcaatccgctgatagatggacgtatatctgatcagctggttggtggggtaacggcctaccaaggcgacgatcagtagccggactgagaggtttaacgggcacaatgggaatgggatacgggccagactcctaagggaggcagcaggtgggaataattcgaaatggaggaaaacctgacgcagtgacgccgcgggcaggaagaaggttttcggattgtaaactgctttagacagggaagaaaaaagacagtacctgtagaagaagctccggctaactacg

SEQ ID NO: 4984 - DNA, 490 bp, Unknown
  Ascusbbf_1377991, encodes 16S rRNA
agagtttgatcctggctcaggatgaacgctggcggcgtgcctaatacatgcaagtcgaacgaggtttctcttcggggaaacctagtgtcgaacgggtgagtaacacataggtaatctacctttcagaatgggatacccaagagaaattttggctaataccgtatacaatcatttctccgcatgtagatttgatgaaagtggctccaaagcctcgctgttagatgaacctgtgacacattatctagttggtgaggtaacaacccaccaaggcgaagatgtgtagctgatctgagaggataatcgggcacaatggtactgcacaacggaccatactccaacgggaggaagcagtagggagttttcggaaatgggggaaaccctgaccgagaaacgccgagtgatttagaaggccctctgggtcgtaagaatctgttgtaaaggagaaatggtagtgggaggaaatgcccattatttgatagtactttattag

SEQ ID NO: 4985 - DNA, 490 bp, Unknown
  Ascusbbf_1342025, encodes 16S rRNA
agagtttgacatggctcaggatgaacgctagcgataggcctaacacatgcaagtcgaggggcagcacatgaagtagcaatacagatggtggcgaccggcgcacgggtgagtaacgcgtatgcaacctacctacaacaggggaataactcgttgaaagacggactaataccccataatacagggatcccgcatgggaatatttgttaaagatttatcggttgtagacgggcatgcgttccattagctagttggtgaggtaacggctcaccaaggcaacgatggataggggaactgagaggtttatcccccacactgggaacggggaacggaccagactcctacgggaggcagcaggggggaaaaattgccaatggacgcaggtctgaaccagcccagtcgcgtgaaggaagaaggccctacgggttgtaaacttcttttgtaagggaataaagtgagccaagtgtggctttttgcatgtaccttacgaata

SEQ ID NO: 4986 - DNA, 490 bp, Unknown
  Ascusbbf_1342039, encodes 16S rRNA
agagtttgatcctggctcaggacgaacgctggcggcgtgcttcatacatgcaagtcgaacgggaagctgacttcggtctgtggatagtggcggacgggtgagtaatatgtaggtaatctgcctcagagagggggacaactgggggaaactcttgcttatacaccatatgagcttggctgcaatgccaatctttagaactccggtgctctgcgatgagccggaatctgattggcttgttggcggtttgatggaccaccaagtcgacgatcagtagctggttacagaggaggaacagccacaatgggaccgagacaacgcccaaactccaacgggaggcagcagtagggaattatgcgcaatgggcgaaagcctgacgcagcaacgccgcgtgtgagatgacacccttcgggatggaaaacactgtcagtagagacgaaacttgacggtacctacagaggaagcaccggctaactccgtgccagcagccgcg

SEQ ID NO: 4987 - DNA, 490 bp, Unknown
  Ascusbbf_1323777, encodes 16S rRNA
agagtttgatcctggctcgggatgaacgctggcggcgtgcttaacacatgcaagtcgaacggagttatctcgctgaggagagcttgctcaaatcttgcgataacttagtggcggacgggtgagtaacgcgtggatcacctgccttataccgggggataacacttagaaataggtgctaatcccgcataagcgcccgatcccgcatgggaaagtgtgaaaaactccggtggtataagatgactccgcgtctgattagctagttggtgaggtaacgtccaaccaagtcaacgatcaatagccggcctgagagggtgaacggcaacattgggactgagacacggcccaaacgcctacgggaggcagcagtggggaatattgcacaatgggggaaaccctgaggcagcgacgccgcgtgagtgaagaagtatttcggtatggaaagctctatcagcaaggaagaaaaaatgacggtacttgactaagaagcccc

SEQ ID NO: 4988 - DNA, 490 bp, Unknown
  Ascusbbf_1342036, encodes 16S rRNA
agagtttgatcatggctcagagcgaacgctggcggcaggcctaacacatgcaagtcgagcgcccgtagcaatacgggcgcggcagacgggagagtaacacgtgggaccgtacccttcagttcggaataacccggggaaactcggactaataccgaatacgtccgtaaggagaaagatttatcgctgaaggatcggcccgcgtctgattagctagttggtggggtaatggctcaccaaggcgacgatcagtagctgttctgagaggaaggccccccacactgggactgagacacggcccagactcctacgggaggcagcagtgaggaatattggtcaatggcggtaacgctgaaccagccaagtagcgtgagggattacggccctatgggttttaaacctcttttgttagggagcaacctatggcactagtgccatactgcgagtacctttcgaataagcatcggctaactccgtgccagcagccgcggta

SEQ ID NO: 4989 - DNA, 490 bp, Unknown
  Ascusbbf_1445236, encodes 16S rRNA
agagtttgatcatggctcagagcgaacgctggcggcaggcctaacacatgcaagtcgagcgcccgtagcaatacgggagcggcagacgggagagtaacacgtgggaacgtacccttcagttcggaataacccggggaaactcggactaataccgaatacgtccgtaaggagaaagatttatcgctgaaggatcggcccgcgtctgattagctagttggtggggtaatggctcaccaaggcgacgatcagtagctgttctgagaggaaggccccccacactgggactgagacacggcccagactcctacgggaggcagcagtgggaaatatgggtcaatggcggtaaggctgaaccggccaggaggcgtgagggattacggccctaggggttttaaacctcttttgttagggagcaacctagggaactagggcaatactggaagtacctttcgaatagcatcggctaactccgtgccagcagccgcggtaa

SEQ ID NO: 4990 - DNA, 490 bp, Unknown
  Ascusbbf_1378051, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaaagtcggattaataccctatgttttccgttgaggacatctgaagtggaacaaagatttatcgctaagggatgaggctcgtctgattagggtgttggcggggtaacggcccaccaagccatcgatcagtaggggttcttagaggaggtgctcacacatcgggattgggaaacggaccaaactccaacgggaggaagcagtgaggaatagtggtcaatgggcgagagcctgaaccagccaagtagcgtgcaggatgacggccctatgggttgtaaactgcttttgcatgggaataaagtgagggacgtgtccctttttgtatgtaccatgagaata

SEQ ID NO: 4991 - DNA, 490 bp, Unknown
  Ascusbbf_1377971, encodes 16S rRNA
agagtttgatcctggctcagaatgaacgttggcggcgtggattaggcatgcgagtcgtgcgggtgtagcaatacaccagcggcgaaagagacagtaatgtatagattatctgccctcaggacgggaatagcggcgggaaactgccggtaatgcccgataatgtctccggatcaaaggtgtgagtccgcctggggatgagtctatatcctattagctagttggtaaggtaacggcttaccaaggctgtgatgggtagcgggtgtgagagcaggacgcgcgtcattgggactgagacactgcacagaccccgacgggtggctgcagtcgagaatcttcggcaagggacgcaagtcggaccgagcgacgccgcgtgcgggaggaaggccttcgggttgtaaaccgctgtcagtggggaggaaggcttcgtgaagagcgaagtttgacctatccgcagaggaagtgagggctaagctcgtgccagcagccgcgg

SEQ ID NO: 4992 - DNA, 422 bp, Unknown
  Ascusbbf_1377977, encodes 16S rRNA
agagtttgatcctggctcaggatgaacgctagctacaggcttaacacatgcaagtcgaggggcagcatgtatctggcttgctagctatgatggcgaccggcgcacgggtgcgtaacgcgtatccaacctgccgtttagccgggaacagcccggcgaaagcgagattactacccgatgttgtgcgtagtccgcatggcaggcgcaccacaaggtttaccggtaagcgcccgggatgcgtacgagtagttggtgggaggggtagcggccaccaggcgcaacgcgggtcgggccaagtagcgggcaagacgactgccttacagattgtaaacggcttttatgcgggggtaaagtgtccaactgggggaatagtgctaataccgcatgaaaaaggacggacaaaccccgcgcgacgccgcggtaat

SEQ ID NO: 4993 - DNA, 490 bp, Unknown
  Ascusbbf_1445377, encodes 16S rRNA
agagtttgatcctggctcaggataaacgctggcggcgcacataagacatgcaagtcgaacgaacttattcgaaagtttactttttaagcgtttagtggcggactggtgagtaacgcgtaagcaatctgcctatcatagtagaataacagtgagaaatcattgctattaccgcatatgctgttagtctctcatgatacaaatagaaaagaagcaatccgctgagagatgagcttgcgtctgattagttagtgggtggaataacggcctaccaagacgatgatcagtagcgggactgagaggttagacggccacattgggactgagcgacggcccagagtcagacgggaggcagcaggcgggaatattgcgcaatggaggaaactctgacgcagggatgccgcgtgcaggaagaagggtttcggagtgtaaactgctttagatagggaagaaaaaatgacggtacctatagaataaggtccggctaactacg

SEQ ID NO: 4994 - DNA, 490 bp, Unknown
  Ascusbbf_1377966, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaacgtcggattaataccctatgttttccgttgaggacatctgaagtggaacaaagatttatcgctaagggatgtggatgctgcttattaggtttgttgcggggtaacggcccaccaagccgtctatcagtatgggttctgagagcacgatcacgcacatgaggacgtggaaacggaccacactcctacgggaggccgcagtgaggaatattggtacatgggcgagagcctgaaccagccaagtagcgtgcaggatgacggccctatgggttgtaaactgcgtttgcatgggaataaagtgagggacgtgtccctttttgtatgtaccatgagaat

SEQ ID NO: 4995 - DNA, 490 bp, Unknown
  Ascusbbf_1377897, encodes 16S rRNA
agagtttgatcctggctcaggatgaacgctagcgataggcctaacacatgcaagtcgaggggcagcacatagagtagcaatacttttggtggcgaccggcggatgggtgagtaacacgtatgcaacctaccttctacagtggaataacccgttgaaagacggactaatgccgcataacacaggggctccgcatggagatatttgttaaagattcatcggtagaagatgggcatgcgtatgattagctagttggtaaggtaacggcttaccaaggcaacggtcattaggggttctgagaggaaggtcagccacactggtacagagacacggaccagactcctacaggaggcagcagcgaggaatagtggtcaatgggcgagagcgtgaaccagccaagttgcgtgaagggagactgtccgatggagtgtaaacttcttgtgtcagagactaaagttaaccacgtgtggttttttgcatgtacctgacgaat

SEQ ID NO: 4996 - DNA, 490 bp, Unknown
  Ascusbbf_1341908, encodes 16S rRNA
agagtttgatcctggctcaggatgaacgctggcggcgtgcttaacacatgcaagtcgaacggagttatctcgctgaggagagcttgctcaagtcttgagataacttagtggcggacgggtgagtaacgcgtggataacctgccttataccgggggataacacgtagaaataggtgccaataccgcataagcgcacgatcccgcatgggagagtgtgaaaaactccggtgagataagatggatccgcgtctgagtggatagttggtgaggtaagggcccaccaagtcaacgatcagtggccgcctggggaggatgaaaggccagatcggaactgcgacacggcccaaaatcctactgtaggcagcagtggggaatattgcaaaatgggggaaaccctgatgcagcgacgccgcgtgagtgaagaagtatttcggtatgtaaagctctatcagcaaggaagaaaaaaatgacggtacttgactaagaagccc

SEQ ID NO: 4997 - DNA, 490 bp, Unknown
  Ascusbbf_1445402, encodes 16S rRNA
agagtttgatcctggctcaggatgaacgctagcggcaggcttaacacatgcaagtcgaggggtaacgcggtgtagcactactcttgcgacgaccggcgcacgggtgcgtaacgcgtatgcaacctacctgtaccaggggtataacggagagcaatttccactaatcccccatcttgttattctttcgcatgttcggataacgaacgcttcggtggttacggatgggcatgcgtgccattagctagttggtaaggtaacggcttaccaaggcgacgatgtctaggggagctgggcggcttatcgccaacacgggtactgagaaacggaccagactcctacgggaggcagcagtgaggaattgtggtcaatggacggaaggctgaaccagccatgccgcgtggaggaagaaggtcctatgggttgtaaactccttttgtgcgggagtaataagggcgatgcgaagcccgatgagagtatcggacgaataagc

SEQ ID NO: 4998 - DNA, 490 bp, Unknown
  Ascusbbf_1323905, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaaagtcggattaataccctatgttttccgttgtggacatctgaagtggaacaaagctttatcgctaagggatggagatgggtctgattaggttgttggcggggtcacggcccaccaagccatcgatcagtaggggttctgagaggaaggacccccacgttggtcatgagaaacgacacaaactcctacggaaggcagcagtggtgaagattggtagatgggcgggagcctgaaccagccaagtagcgtgcaggatgacggccctatggattgtaaactgcttttgcatgggaataaagtgagggacgtgaccctttttgtatgtaccatgagaat

SEQ ID NO: 4999 - DNA, 490 bp, Unknown
  Ascusbbf_1347197, encodes 16S rRNA
agagtttgatcctggctcaggataaacgctggcggcgtacataagacatgccagtcgaacggtctcatctcattcttttcgtttttttgctgtcagcggcggactggtgagtaatgctttatcaaccttcctatctgcggggacccacagttggaaacgactgcttataccgcatatgcctcgagaatcacatggttcaagtgggaaaggagccatccgctgatagatggacttatatctgattagctagttggtggggtaacggcctaccaaggcgacgatcagtagccggcctgagcggttaaccggcgaccttggtactgggatccggcccgggctcctacgggaggcagcagtcgggaatattgcgcaatggaggaaactctgacgcagtgacgccgcgtgcaggaagaaggttttcggattgtaaactgctttagacagggaagaaaaacgacagtacctgtagaataagctccggctaactacg

SEQ ID NO: 5000 - DNA, 490 bp, Unknown
  Ascusbbf_1347196, encodes 16S rRNA
agagtttgatcctggctcaggacgaacgctggcggcatgcctaacacatgcaagtcgaacggaggcggaaacaccttagtgtcgtactggtgagtaacgcgtgagtaacctgccttatacacagggattccagttagaaatgactgctaataccggataagaccacagtccggcatcggacaggggtcaaagtgaattagcggtataagatggtctcgcgtccaattagctagttggtggggtaatggcccaccaaggcaacgattggtagccgacccgagagggtgatcggccacatgggaactgggccccgatccaaactcctgcgggcggccgcagtggggaatattgggcaatggaggaaactcttgcccagcaatgccgcgtgggtgatgaaggtcttatggattgtaaaactctttgattagggacgaacaaatgacggtacctaaagaacaagccccggctaactatgtgccagcagccgcgg

SEQ ID NO: 5001 - DNA, 490 bp, Unknown
  Ascusbbf_1445880, encodes 16S rRNA
agagtttgatcctggctcaggatgaacgctagctacatgcttaacacatgcaagtcgaggggcggcattggattagcttgctaatcctgatggcgaccggcgcacgggtgagtaacgcgtgtccaaccttccctatagtagcggatagcccggcgaaagtcggattaatacgctatgttgtatttagaggacatctgaagaataccaaaggtttacctctataggatggggatgcgtctggttaggttgttggcgggggaacggcccgccaagccatcgatcagtagggggtctgagagggaaggtccccaccatgggaactgggcaacggtcaaaccccctacggagggaggcagtggggaatatgggtaaatgggcaggagctggaaccggcaaagtagcgtgcaggataacggccttatgggttgtaacctgcttttatcgggggttaaggtgcgggacgcgtgccgtttggtaggaacccgatgaa

SEQ ID NO: 5002 - DNA, 486 bp, Unknown
  Ascusbbf_1324298, encodes 16S rRNA
agagtttgatcatggctcagaacgaacgctggcggcaggtcttaggcatgcaagtcgaacggacgacagagtggcttgccattctgaagttagtggcgcacgagtgagtaacgcgtgggaaactgcccttcgctggggaataacgtctggaaacggacgctaataccgcatccgcccgcaaggggaaaggtttatcggtgttggaagtgcccgggttggtttagcttgtggttggggtaatggcctacaaaggcgatgtgccttagctggtctgggaggacgatcagccacgctggaactgagacacggtccagactcctacgggaggcagcagctaagaatattgggcaatggaggaaactctgacccagccatgccgcgtgaatgaagaaggccttcgggttgtaaagttcttttagtcatgaagatgatgacagtagtgacagaagaggcaccggctaacttcgtgccagcagccgcggtaat

SEQ ID NO: 5003 - DNA, 490 bp, Unknown
  Ascusbbf_1445866, encodes 16S rRNA
agagtttgatcctggctcaggataaacgctggcggcgcacataagacatgcaagtcgaacggacttaactcattctttacgattgatagcggttagtggcggactggttagtaatgtataagtaacctgcctatcagatgggaacaacagttggaaacgactgctaataccgcatatgcctcgagaatcacatggttcaagtgggaaaggagcaatccgctgatagagggactaatatctgattagctagttggtggggtaacggcctaccaaggcgacgatcagtagccggactgaggggttaaacggccacactgggaccgagataaggcccagactacgaagagaggcagcagtcgggaagagtgagcaatggaggaaacgctgacgcagagacgccgcgggcaggaagaaggttttcggattgtaaactgctttagaaagggaagaaaaaagacagtacctgtagaataagctccggctaactacg

SEQ ID NO: 5004 - DNA, 490 bp, Unknown
  Ascusbbf_1377470, encodes 16S rRNA
agagtttgatcctggctcagaacgaacgctggtggcgtgtcttatacatgcaagtcgagcggtccagcaatggatagcggcgaacgggtgagtaacgcgtaagcaatctgccccctgctcgggaatagccgtgccaacgcgcggataataccggatatcgtggggccctgcatagggccttgacaaaagatttatcggcaggggatgcgcttgcgtccgattagctggttggcggggcaacggcccaccaaggcgacggtcggtagccggcctgagagggtgatcggccacagtgggaccgggacacggcccagacgcctaagggaggcagcagtagggaatattgcacaaggggggaaaccctgatgcagcaacgccacgtgtgggaagaagcatttcggtgtgtaaaccacggtcgtgagggaataaggctaattttcggattagttgaatgtacctcgagaggaagcaccggcaaacttcgtgccag

SEQ ID NO: 5005 - DNA, 490 bp, Unknown
  Ascusbbf_1445847, encodes 16S rRNA
agagtttgatcctggctcaggatgaacgctagcgacaggcttaacacatgcaagtcgaggggcagcatggaggtagcaatacttctgatggcgaccggcgcactggtgagtaactcgcatgcaaccttcctctgcttgggtgataacccgcggaaccgcggcctaataccctgtatgcactgctgcctcctgatgtccgtgtgatagatcttcgtcctggcatgggcatgcggcgcattcgctgtttgtcgtttcaacggcccaccaaggccacgatgcgtaggggttctgagaggaaggtacacaaaactggtaatgagacacggaccagactccgacgggaggaagaagtgaggaatattggtcaatgggaggaagcctgaaccagccaagtcgagtgagggatgacggcccgacgggttgtaaaccgcttttgccggggagtaacgcgatccacgtgaggggcgctgagagtacccgatgaataagc

SEQ ID NO: 5006 - DNA, 490 bp, Unknown
  Ascusbbf_1324346, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttagagattcgcatgtttctctaacgaaagcttcgttggttacggatgggcatgcgtgacattagagagtgggtaaggtaacggcttaccaaggcgacgatgtctaggggagctgagaggcttatgccacacacgggtactgagacacggaagagactcatacgggggggaacagtgaggaatagtggtaaagggacggaagtctgaaccagccatgccgcgtgaatgaagaaggccttcgggttgtaaagttcttttagtcatgaagatgatgacagtagtgacagaaaaagcaccggctaacttcgtgccag

SEQ ID NO: 5007 - DNA, 369 bp, Unknown
  Ascusbbf_1377393, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggcgcgaaatttccactaatcccccatattgttattctttcggatgttaggataacgaaagcttcggtggttacggatgtgcatgcgtgacattagctgggtggtaagatagtcctttgggttggaaacgacttttgttggagagtaataagggctttgcgaagcccgatgagagtatcggacgaataagcatcggctaactccgtgccagcagccgcggtaat

SEQ ID NO: 5008 - DNA, 490 bp, Unknown
  Ascusbbf_1377398, encodes 16S rRNA
agagtttgatcctggctcaggataaacgctggcggcgcacataagacatgcaagtcgaacgaacttattcgaaagtttacttttgcagcggttagtggcggactggtgagtaacgcgttagcaatctgcctatcagaggggagtcaacgtgagaaatcattgctaataccgcataagctctgagtatcgcatgatacaaatagatacggagcaatccgacgatagataagcttccgtctgatttgctagttggtgggttaacggcctaccaagacgatgttcagtagccggactgagaggtgaaaaggccacagttgggctgggatacggccccgaatcctacgaggggaaacagtcgggaaaattgcgcaatggaggaaactctgacgcagtgacgccgcgtgcaggaagaagggtttcggagtgtaaactgctttagagagggaagaaaaaaatgacggtacctatagaataagctccggctaactac

SEQ ID NO: 5009 - DNA, 490 bp, Unknown
  Ascusbbf_1324382, encodes 16S rRNA
agagtttgatcctggctcaggatgaacgctagctacaggcttaacacatgcaagtcgcggggcatcatggcatgtagcaatacatgctgatggcgaccggcggatgggtgagtaacgcgtatccaacctggccctatctcgggtacagcccctcgaaagagggattaatccccgatgttccctgggatccgcatgttttccagggcaaaggcatttgtcggataggtatgggtatgcgttccattcgccagtgtgcggggtacgggccccccgagccgacgatggatagggggtctgagaggaaggcacaccaaactgggacggagacacggcccagactcctacgggaggcagcagtgaggaatagtggtcaatggcggtaacgctgaaccagccaagtagcgtgagggattacggccctatgggttgtaaacctcttttgtgagggagcaaccggtggcacgagtgccagtctgcgagtaccgttcga

SEQ ID NO: 5010 - DNA, 490 bp, Unknown
  Ascusbbf_1324388, encodes 16S rRNA
agagtttgatcatggtcaggatcaacgctggcggcgtgcctaatgcatgcaagtcgaacggggtgtccttcgggtcacttccttggctgacgtgtgaggcacacatgggcaacctgccttatggagggggataaccgctggaaacagtgggtaataccgcataatcctggatctcgagtgggagatatagggaaagtcgcaagacgccgacagagtggcctgcgtccgattagctgtacggtgtggtaactgcctaccttggcagtgatcggtagctggtttgagaggattatcagccacacggggcctgagacacggccccgactcatacgggaggcagcagaaaggaattttccgcaatgggcgaaagcctgacggagcaacgccgcgtgtgggatgacgcttttcggagtgtaaaccactgttcgtggggacgaagcactgacggtacccacggaggaaggcccggctaactacgtgccagcagccg

SEQ ID NO: 5011 - DNA, 490 bp, Unknown
  Ascusbbf_1347224, encodes 16S rRNA
agagtttgatcctggctcaggatgaacgctagcgacaggcctaacacatgcaagtcgaggggcagcgcgggagaagcttgcttttcctggcggcgaccggcgcacgggtgcgtaacaggtgtgcaatctgtccatagtcggggaatagcccagcgaaagttggattaatgctccatgtgtcacgaagccgcatgactttgtgatgaaacgtaaggactatgggtgagcacgcttctgattagatagttggtgaggtaacggctcaccaagtcgacgatcagtaggggttctgagaggaagggcccacacattggaaaggacacacgggacaaacacacacgggggaaacaaggtggagaaagggggaaagggggaggggcaaagaaccacaagggtgggtagagggataaggttataggggattaaaatctttttggcccgggggaaaaaacgggccagttgtgctttctgaaaatttaggaaaaataaa

SEQ ID NO: 5012 - DNA, 490 bp, Unknown
  Ascusbbf_1324294, encodes 16S rRNA
agagtttgatcctggctcaggataaacgctggcggcgcacataagacatgcaagtcgaacggacttaactcattctttacgattcatagcgggtagtcgcggaatgggtagtaatgtagtagtaaccttcctatcagagaggaacaacagttggaaacgactgctaataccgcttattccacgcgaatcacatggttaaagagggaaaggagcaatccgcggatagatggattgataactgattggctagttgctggggtaacggcctccaaaggcgacgagaagtagccgtacgggggggttgagaggccaactagggtcctgcgtacggccgagactacgaagggaggaagaaggcgggaataatgagcaatggaagaagcgcggaggaagagacgccgcggggaggaagaaggttttcggattggaatatgctttagaaagggaagataaaagacagtacctgaagaataaggtccggctaactacg

SEQ ID NO: 5013 - DNA, 490 bp, Unknown
  Ascusbbf_1347249, encodes 16S rRNA
agagtttgatcctggctcaggatgaacgctagctacaggcttaacacatgcaagtcgaggggcagcggggggatagcttgctttctttgccggcgaccggcgcacgggtgtgtaacgcgtatccaaccttccccatactcgggaatagccctgcgaaagtcagattaatgcccgatggtcttagtatatgacatcatgctttaagtaaagattcatcgctatgggatggcgatgcgtctgtttaggaagtgggcggggtaacggcccaccaagtcgtcgatcagtaggggttctgagaggaaggtcccccacattggaactgagaaacggtccaaactcctacgggaggcagcagtgaggaatattggtcaatggtcgagagactgaaccagccaagtagcgtgaaggatgactgcccgatgggttgtaaactgcttttaggcggggataaagtgccgcacgcgtagggtattgcaggtaccgcgtgaat

SEQ ID NO: 5014 - DNA, 490 bp, Unknown
  Ascusbbf_1444509, encodes 16S rRNA
agagtttgatcctggctcaggacgaacgctagcgacaggcttaacacatgcaagtcgagcggcagcgcgggagaagcgtgctcttcctggcggcgcgcggcgcacgggcgcgctacaggggtgcaatctgtccatagtcggggaatagcccagcgaaagttggatgaatgctctatgcgtcactaagccgcctggctttgtgatgacacgtaaggactatgggtgagcacgcttctgactagacagttggtgaggtagaggctcaccaagtagacgatcagtaggggttctgagaggaaggtccccaacattggaactgagacacggtccaaaatcctacgggaggcagcagtgaggaatattggtcaatgggcgagagcctgaaccagccaagtagcgtgaaggatgaaggttctatggatgaaaaacttcttttgtccgaaagtaaaaaaggccacgtgtggcttcttgcaagtatcggacgaataag

SEQ ID NO: 5015 - DNA, 490 bp, Unknown
  Ascusbbf_1444618, encodes 16S rRNA
agagtttgatcctggctcaggatgaacgctagctccaggcttaacacatgcaagtcgaggggcagcaggacaatagcttgctattgtcgctggcgaccggcgcacgggtgagtaacgcgtatccaaccttccccttattagggcatagcccggcgaaagtcggcttaataccctatgttattcgtctcggacctctgaagttaatcaaagatttatcgctacgggatggggatgcgtctgtttaggttgttggcgtgttaacggcccaccaagccatctatcagtagtggttctgagaggaaggtccccaacattggaactgagacacggtccaaactcctacgggaggcagcagtgaggaatattggtcaatgggcgagagcctgaaccagccaagtcgcgtgaaggatgaaggtcctatggattgtaaactgcttttgtccgagggtaaaaaaggccacgtgtggcttcttgcaagtatcggacgaat

SEQ ID NO: 5016 - DNA, 490 bp, Unknown
  Ascusbbf_1444602, encodes 16S rRNA
agagtttgatcctggctcaggatgaacgctggcggcgtgcctaacacatgcaagtcgaacggaaaggattcttcggaattctttcattggcggccgggggagtaacgcgtgggtaacctgccccaaacagcggcacaacagctggaaacggcttctaataccgcataagcgcacagtgctgcatggtacagcgtgaaaagagtttatcggtatgggatggaccagggtcggattagacagatggggtggtaacggccctccaagccgacgaaaagtaggcgacctgggaggtggacgggcgacattgggactgagacacggaccaaacaccaacagggggcagcagtgggggatattgcacaacgagcgaaagcctgatgcagcgaccccgcgtgagtgaggaagtatttcggtaggtaaagctctagcagcagggaagaaaatgacggtacctgactaagaagccccggctaactacgtgccagcagcc

SEQ ID NO: 5017 - DNA, 490 bp, Unknown
  Ascusbbf_1324005, encodes 16S rRNA
agagtttgatcctggctcaggatgaacgctggcggcgtgcctaatacatgcaagtcgaacgagggtgcttgcaccctagtggcgaacgggtgagtaacacgtaggtaacctgccctttagcttgggatacccagaggaaactttggctaataccggataacaacagaagaggcatctcttcagtttgaaaggccctttacggggtcacttaaggatgcacctgcggcgcattagctagttggtgagataccagcccaccaaggcgaggatgcgtagcctacctgagagggtgatcggccacattggaactgggacacggtccaaaagcctacgggaggcagacgtcaggaggttacggcaatgggggaaaccctgaccgggcaacgccgcgagagtgatgacggccctatgggttgtaaagctctgttgtaagggacgaatgattcgcttaggaaatgaagcgggtttgacggtaccttaccagaaagca

SEQ ID NO: 5018 - DNA, 490 bp, Unknown
  Ascusbbf_1378700, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcttatccacccttccccttagtagggcatagcccggcgaacgtcggcttattcccctttgttttccgttgaggacatctgaagtggaacaaagatttatcgctacgggatggggctgcgtctgattaggttgttggcggggtaacggcccaccaagccatcgatcagtaggggttctgagaggaagtgcccacacattggtactgggaaacggaccaaacgccgacgggaggcagcagtgaggaatattgggcaatgggcgagagactgaaccagccaagtagcgtgaaggaggacggccctatgggttgtaaactgcttttgcaggggaataaagtgagggacgtgtgccggtttgtatgtaccatgagaat

SEQ ID NO: 5019 - DNA, 490 bp, Unknown
  Ascusbbf_1377496, encodes 16S rRNA
agagtttgatcctggctcaggatgaatgctagctacaggcttaacacatgcaagtcgaggggcagcataacgaaagcttgctttcgttgatggcgaccggcgcacgggtgagtaacgcgtatccaaccttccccttagtagggcatagcccggcgaacgcctgattaataccctctgttttccgttgaggacatctgaagtggcacaaagatttatccctaagggatggagatgcgtctgagtaggttgtgggcggggtaacggcccaccacgccagcgatcagtaggcgttctgaggggaaggtacccgtcatgggaactgagaaccggacaaaacacctacgggaggcagtagggaggaatattggtccaggggcgagggcctgaaccagccaagtagcgtgcaggatgacggccctatgggttgtaaactgcttttgcatgggaataaagtgagggacgtgtcactttttgtatgtaccatgagaat

SEQ ID NO: 5020 - DNA, 490 bp, Unknown
  Ascusbbf_1445862, encodes 16S rRNA
agagtttgatcctggctcaggacgaacgctggcggcgtgcttaacacatgcaagtcgaacggtaacgccccagcttgctggggtatacgagtggcgaacgggcgagtaacacgtgggtgacttgccccgcacctcgggataagcctgggaaactgggtctaataccggatagcactgtaccgtgagggtgtggtggaaagtttttcggtgtgggaggggcctgcggcctatcagcttgttggtggggtattggcctaccaaggcggcgccgggtagccggcctgagagggtggtcggccacatggggactgagacacggccgagactactgcgggaggcagcagtagggaagattgcacaatggggagaagccggatgcagcgacaccgcgtgggggatgacgaccttcgggttgtagactccttagaccgtcaacgaaggttttctgacggtagatggagaagaagcaccggctaactacgtgccagca

SEQ ID NO: 5021 - DNA, 490 bp, Unknown
  Ascusbbf_1347284, encodes 16S rRNA
agcgtttgatcatggctcaggatgaacgctggcggcgtgcttaacacatgcaagtcgaacgaggtctaattacgtcagttttctgacggaagctcctgtactgagtggcggacgggtgtgtaacgcgtgggacacctgccctgctccgcggtataccagttggcaacgcctgttaataccgcataagcgcacagcaccgcattgtgcagtgtgtaaaactccggtgtaaccggatggtcccgcgtctgattgggccgttcgcagggttaccgccttccacaccgacgatcagtagccgtcctgggagagggaacgggcacagtgggactgagacacgacccaaacacctacgggaggcagcagtggggaatattgaacagtgggggaaaccctgatggcgcggcgccgcgtgagtgaagaagtatgtcggtatgaaaagctctagcagcagggaagaagatgacggtacctgcagaagcagcaccggcta

SEQ ID NO: 5022 - DNA, 490 bp, Unknown
  Ascusbbf_1377455, encodes 16S rRNA
agagtttgatcatggctcaggatgaacgctggcggcgtgcctatcacatgcaagtcgaacggagttactttggtgaagttttcggacggatctgatttaacttagtggcgtacgggtgagtaatgcgtgagcaacctgcccttcagagggggacaacagttggaaacgactgctaataccgcataatgtatccgggagccatctcctggataccaaaggagaaatccgctgatggatgggcacacgtctgattagctagttggtgaggtaacggctcaccaaggctgcgatcagtagccggacttagaggttgacggaccacattggaactggaggacggcccagcgaccaacgggaggcagcagtggggaagattggccatgggcgaaagcctgacccagcaacgccgcgtgaaggaagaaggccttcgggttgtaaacttcttgtaagagggacgaagaagtgacggtacctcttgaataagcaacgg

SEQ ID NO: 5023 - DNA, 490 bp, Unknown
  Ascusbbf_1444576, encodes 16S rRNA
agagtttgatcatggctcaggacgaacgctggcggcgtgcttaacacatgcaagtcgaacggtgaagtcggagcttcctctgccggatcagtggcgaacgggtgagtaacacgtgagtaacctgcccctgactctgggataaccattggaaacgatggctaatactggatacgagttgcctccgcatggagagtgcctggtaagatctatctgtctgggatggactcgcggcctttcggcttgttggtggggtaatggactaccaagacgacgacgggtagccggcctgatagtgcgaccgggcacactgggactgagacacggaccagactcctacgggaggcagcagaggggaatattgcacaatgggcgaaagccggatgcagcgacgcggcgtgagggatggcggccttcgggttgtaaaccactttcagcagggaagaagcgaaagtgacggtacctgaagaagaagcgccggctaactacgtgc

SEQ ID NO: 5024 - DNA, 490 bp, Unknown
  Ascusbbf_1324227, encodes 16S rRNA
agagtttgatcatggctcaggataaacgctggcggcgcacataagacatgcaagtcgaacggacttaactcattcttaacgattgagagcggttagtggcggactagtgcgtactgtataagtaacctgcctatcagaggggaacaaccgttggaaacgactgctactaccgcctatgccacgagaatcacatggttcaagtgggcaaggagcaatcctctgatagttggacttatatctgattagctattttgtggggtaacggcctaccacgtcgacgataagtagccggactgagaggttacacggacaacttgggactgagatacggcccagactcctacgagaggcagcagtcgggaatattgcgcaatggaggaaactctgacgcagtgacgccgcgtgcaggaagaaggttttcggattgtaaactgctttagacagggaagaaaaaagacagtacctgtagaataagctccggctaactacg

SEQ ID NO: 5025 - DNA, 490 bp, Unknown
  Ascusbbf_1324240, encodes 16S rRNA
agagtttgtcatggctcaggatgaacgctagctaccggctctacacctgcaagtcgagacgaaacgatattgaaagcttgcttttgttaggcgtcgaccggcgcacgggtgagtaactcttatcaaacatccctggaaatggggcataatccgtggacacgcggcctaatgtcctatgtgctccgaagaggacatctgatttggagtaaagattcctcgtttccggatggggatgcgtctgattagcttcctggcggggtaacggcccaccagggcgacaatcagtgggggttcggggaggtagagctcgcatatgagaacgatgagccagttcgagactctgagacgggcaggactcatgcaggagggagcaggagggagtatcgcaaactgcagagtaccgtgctgcagcaatgccgcatgggtgaagaagggcttcgaggtgtaaagaaattgcgccgcgggtggtgtaatgaagttaccgtaagaa

SEQ ID NO: 5026 - DNA, 490 bp, Unknown
  Ascusbbf_1445719, encodes 16S rRNA
agagtttgatcctggctcaggatgaacgctagctacaggcctaacacatgcaagtcgaggggcagcataccgaaagctttcttttgtttatggcgaccggcgcacgggtgagtaacgcgtatccaaccttccccttagtatggcatatcccggcgaaagtcggattaataccctttgttttcctttgtggacatctgaattggaataaatatttatcgctcatggatggtgatgcgtctgattaggtttgtggcgggttaacggcccaccaagcgatcgatcagtaggggttctgagagttcggtcccccacattggtactgagacacgacacaaactcctacgggaggcagcagtggggaatattggtcaatggacgagagcctgaaccagccaagtagcgtgcaggatgacggccctatgggttgtaaactgctttcgcatgggaataaagtgagggacgtgtccctttttgtatgtaccatgagaat

SEQ ID NO: 5027 - DNA, 490 bp, Unknown
  Ascusbbf_1324253, encodes 16S rRNA
agagtttgatcatggctcaggataaacgctggcggcgcacataagacatgcaagtcgaacggacttaatcaatagtttactattgatgcggttagtggcggactggtgagtaacacgtacgtcacccgcctatcagaggggaacaacagttagaaatgactgctaataccgcatatgccataactagcgcatgatcgaagtgggaaagtagcagtccactgatagatggacttgcgtctgattagatagttggtagggtaacggcctaccaagtcgacgatcagtagccggactgagagattaaacggcgaacttgggactgaggtacggcccagactcctaagggaggcagaagtcgggaatattgagcaatggaggaaacgctgacgcagtgacgccgcggggaggaagaaggttttcggattggaaactgctttagacagggaagaaacaagacagtacctgtagaataagctccggctaactacgt

SEQ ID NO: 5028 - DNA, 490 bp, Unknown
  Ascusbbf_1324248, encodes 16S rRNA
agagtttgatcctggctcaggataaacgctggcggcgcacataagacatgcaagtcgaacgaacttaatcgaaagtttacttttgacgcggttagtggcggactggtgagtaacgcgtaagcaatctgcctatcagaggggaataacagtgagaaatcattgctaataccgcataagctgtgagtatcgcatgatacaaatagaaaaggagcaatccgctgatggatgagcttgcgtctgattagttagttggtggggtaacggcctaccaagacgatgatcagtagccggactgagaggttaaacgggccaattgggactgagataccgcccagaatcctaagggggggaggagtagggaatattgcggaaatgaggacacgctgacgcagtgacgccgcgtggaggaagaaggttttcggattgtaaacttctttagatagggaagaaaaaaatgacggtacctatagaataagctccggctaactac

SEQ ID NO: 5029 - DNA, 490 bp, Unknown
  Ascusbbf_1347338, encodes 16S rRNA
agagtttgatcctggctcaggataaacgctggcggcgcacataagacatgcaagtcgaacggacttaactcattcttaacgattgagagcggttagtggcggaccggtgagtaatgtataagtaacctgcctatcagaggggaacaacagctggaaacgactgctaataccgcatatgtcacgagaatcacatggttcaagtgggaaaggagcaatccgctgatagatggacttatatctgattagatagttggtggggtaacggcctaccaaggcgacggtcagtagccggactgagaggttgagcgacgaacttgggactgagatacggccgaagtgcctacgggaggcagcagtcggaaatattgcgcaagggaggaaacgctgacgcagtgacgccgcgggcaggaagaaggttttcggattgtaaactgctttggacagggaagaaaaaagacagtacctgtagaataagctccggctaactacg

SEQ ID NO: 5030 - DNA, 490 bp, Unknown
  Ascusbbf_1346996, encodes 16S rRNA
agagtttgatcctggctcaggataaacgctggcggcgcacataagacatgcaagtcgaacggacttaatcaatagtttactcttgattcggttagtggcggactggtgagtaacacgtaagtaacctgcctatcagagtggaacaacagttagaaatgactgctaataccgcatatgccatacctatcgcatgatagaagtgggacaggagcaatccactgttagatggacttgcgtctgattagatagttggtagggtaacggcctaccaagtcgacgatcagtagccggactgagaggttaaacggcaacattaggaccgagatacggcacagacgccgacgggaggcagcagtcgggaagattgcgcaagggaggaaactctgacgcagtgacgccgagtgcaggaagaaggttttcggattgtaaactgctttagacagggaagaaacaagacagtaccggtagaataagctccggctaactacgt

SEQ ID NO: 5031 - DNA, 486 bp, Unknown
  Ascusbbf_1323595, encodes 16S rRNA
agagtttgatcctggctcagaacgaacgctagcggcaggccttaggcatgcaagtcgaacggacgccagagtggcttgcccttctgaagttagtggcgcacgagtgagtaacgcgcgggaaactgcccttccctggggcctaacgtctggatacggacgctagtaccgcatacgcccgcaaggcgaaggacttatcggtgatgggtgtgcccgcttgtgattagcttgttgggggggtaatggcctaccgaggcgctgctccctagctggtctgcgcggacgatcagccacgctggaactgagacacgggccagactcctacgggaggcagcagctaagaatattgggcaatggaggaaactctgacccagccatgccgcgtgaatgaagaaggccttcgggttgtaaagttcttttagtcatgaagatgatgacagtagtgacagaaaaagcaccggctaactgcgtgccagcagccgcggtaat

SEQ ID NO: 5032 - DNA, 486 bp, Unknown
  Ascusbbf_1377248, encodes 16S rRNA
agagtttgatcctggctcagaacgaacgctggcggcaggtcttaggcatgcaagtcgaacggacgacagagtggcttgccattctgaagttagtggcgcacgagtgagtaacgcgtgggaaactgcccttcactggggaataacgtctggaaacggacgctaataccgcatacgcccgcaaggggaaagatttatcggtgatgggtgtccccgcgttggattagcttgtttgtcgggtaatggcctaccaaggcgatgatccatagctggtctgagaggacgatcagccaccctggaacggagacacggcccagactcatacgggggacagcaggtaagaatagtggaaaatgggggaaactctgacccagccatgccgcgtgaaagaagaaggcttgcggtgtgtaaagttcttttagtcatgaagaagatgacagtagcgacagaaaaagcaccggctaacttcgtgccagcagccgcggtaat

SEQ ID NO: 5033 - DNA, 490 bp, Unknown
  Ascusbbf_1323601, encodes 16S rRNA
agagtttgatcctggctcaggataaacgctggcggcgcacataagacatgcaagtcgaacggacttaatcaatagtttactattgaagcggttagtggcggactggtgagtaacacgtaagtaacctgcctatcagaggggaacaacagttggaaatgactgctaataccgcatatgccataactatcgcatgatagaagtgggaaaggagcaatccactgatagatggacttgcgtctgattagatagttggtagggtaacggcctaccaagtcgacgatcagtagccggactgagaggttaagcggccaacttgggactgagatacggcacagactcctacgagtggcagaagtggggaatattgagcaatggaggaaactctgacgccgacacgccgagtggaggaagaaggttttcggattgtaaaatgctttagaaagggaagaaacaagacagtacctgtagaataaggaccggctaactacgt

SEQ ID NO: 5034 - DNA, 490 bp, Unknown
  Ascusbbf_1445798, encodes 16S rRNA
agagtttgatcctggctcaggatgaacgctagctacaggcctaacacatgcaagtcgaggggcagcgggggcagagcttgctctgcctgccggcgaccggcgcatgggtgcgtaacgcgtatcgaacctcccccatactcgggaatagccttgcgaaagtaagattaatgcccgatggtctcagaatatgacatcatgctttgagtaaagattcatcggtatgggatggcgatgcgtctgattagatagttggcggggtaacggcccaccaagtcgtcgatcaggaggggttctgagaggacgggcgcgcacattggaactgagagacagaccaaaatcctacgagaggcaggagtcaggaatattggacaatgatcggaagactgaaccagccgagtagcgtgaaggatgcctgccctacgggttgtaaacttcttttatgcgggaatcaagtgccccacgcgtggagtattgcatgtaccgcgtgaat

SEQ ID NO: 5035 - DNA, 487 bp, Unknown
  Ascusbbf_1445792, encodes 16S rRNA
agagtttggcagggagcagaacgaacgagggcggcaggcgtaacacaggcaagtggagcgggagggatggagagcgtgcgagtgagcatgagagaagcgcacgggggaggaacacgggggaacagacctttgggtgggggacaacagggggaaacgactgctaataccgcataagccctgagggggaaagattaattgccgagagattggcccgcggaagattaggtagtaggtggggtaacggcctacctagccgaggatctatagcggtgcggagaggacgatcagccacattggaactgagacacggtccagactcctacgggaggcagcagtgaggaatattgggcaatggagggaactctgacccagccatgccgcgtgagtgaagaaggttttcggattgtaaagctctttcagacgggaagatgatgacggtaccgtcagaagaagcaccggctaacttcgtgccagcagccgcggtaat

SEQ ID NO: 5036 - DNA, 486 bp, Unknown
  Ascusbbf_1324217, encodes 16S rRNA
agagtttgatcatggctcagaacgaacgctggcggcaggtcttagtcaggaaaggagaaaggaagaaagtggggcggggaagggggaacggaggggggaaggagtgaggaaggagagggaaacgggaagggaagggggaagaagggggggaaagggaggagaagaacgcatacgccgggaaggggaaagagttatcggtgatggaggtgcccgcgttggattagcttgttggtgtggtaatggcctaccaaggcgatgatccatagctggtctgagaggacgatcagccacgctggaacggagacacggtcacgcctcctacgggaggcagcagctaagaatattgggcaatggaggaaactctgaaccagccatgccgcgtgaatgaagaaggccttcgggttgtaaagttcttttagtcatgaagatgatgacagtagtgacagaaaaagcaccggctaacttcgtgcccgcagccgcggtaat

SEQ ID NO: 5037 - DNA, 490 bp, Unknown
  Ascusbbf_1377422, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacgttggttaatactcactaccatatggattcacatggttttatattgaaagattcgttggtgccgtatgggctcgcgtaacattcgctagtcggcggggtaacggcccaccgagggtaggatgtttaggggttctgagagtaaggtcccccccactgacactgagacacggtccagactcctacgggaggcagcagtgaggaatattggtcaatgggcggaagcctgaaccagccatgccgcgtgcaggaataaggccctatgggtcgtaaactgtttttccttgagggcaataagggtcacgagtggcccgatgagagtatcaggggaataagca

SEQ ID NO: 5038 - DNA, 490 bp, Unknown
  Ascusbbf_1347403, encodes 16S rRNA
agagtttgatcatggctcaggacgaacgctagcggcgtgcctaacacatgcaagtcgaacggaacttatttagaagattctttcgggatgagtttacttacgtttgggtgcgtacgggtgagtaacgcgtgcgtaacctccctttgagcgggtaataacaatctgaaaatattgctaataccgcataacatatatttgtcgcgtggcaggtatattaaagatttcatcgctcaaagatgaactcgcgtccgattagttagttggggcggtaacggctacccaagaccgcgatcggtagccgaactgagaggttgaacggccacattgggactgagacacggcccagacgccgacgggaggcagcagtgggggatactgcgcaatgggggtaaccctgacgcagcaacgccgcgtgaaggatgaaggttttcggattggaaacttcttttattaaggacgaaaaatgacggtacttaatgaataagctccg

SEQ ID NO: 5039 - DNA, 490 bp, Unknown
  Ascusbbf_1445935, encodes 16S rRNA
agagtttgatcctggctcaggatgaacgctagcggcaggcttaacacatgcaagtcgaggggcagcgcggggtagcaatactctgtcggcgaccgtcggaagggtgcgtaacgcgtgagcaactttcccttcactgggggataggcactggaaacgttgtgtaatactcccttacatatcgattcacatggattgatattgaaagattcgttgctgacggatgcgctcgcgtaacattagctagtcgtcgtggtaacggcccaccgaggctacgatgtgtaggggttttgataggaaggtcacaagcgatggaactaagagacggaccagactcctacgggaggaagcagtgaggaatattggtcaatgggcggaagcctgaaccaggcaggccgcgtgaaggaataaggccctatgggtcgtaaactgcttttccttgagggcaataagggtcacgtggggcccgatgagagtataaggggaataagca

SEQ ID NO: 5040 - DNA, 490 bp, Unknown
  Ascusbbf_1347211, encodes 16S rRNA
agagtttgatcctggctcaggttaaacgctggcggcgcacataatacatgcaagtcgaacgaacttaatcgaaagtttacttttgatgcggttagtggcggactggtgagtaacgcgtaagcaatctgcctatcagaggggaataacagtgagaaatcatttctaataccgcataagctgtgagtatcgcatgatacaaatagataaggagcaatccgctgctagattagcttgcgtctgatgagatagttggtggggtaacggcctaccaagacgatgatcagtatccggattgagagggataaccggcacattgggaatggggtacgggcccgactcctacgggggggagcagtcaggaatattgcgaaatggaaggaactctgaagcaaggaagccgcgggcaggaagaaggttttcggattgtaaacggatttagagagggaagaaaaaaatgacggtgcctatagaagaagcaccggctaactac

SEQ ID NO: 5041 - DNA, 490 bp, Unknown
  Ascusbbf_1377411, encodes 16S rRNA
agagtttgatcctggctcaggatgaacgctggcggcgtgcctaatacatgcaagtcgaacgagggtgcttgcaccctagtggcgaacgggtgagtaacacgtaggtaacctgcccttaagcttgggatacccagaggaaactttggctaataccggataacaacagaggaggcatctcttcagtttgaaaggccctttacggggtcacttaaggatggacctacggcgcattagctagttggtgagataacagcccaccaaggcggggatgcgtagccgacctgagagggtgatcggcccaactggaaccgggacacggtccaaaccccgacgggaggcagcaggaaggaggttgcggcaatgggggaaaccctgaccgagcaacgccgcgtgagtgatgacggccctatgggttgtaaaactctgttgtaagggacgaatgattcgcttaggaaatgaagcgggtttgacggtaccttaccagaaagcc

SEQ ID NO: 5042 - DNA, 490 bp, Unknown
  Ascusbbf_1347381, encodes 16S rRNA
agagtttgatcatggctcaggacgaacgctggcggcgtgcttaacacatgcaagtcgagcggtaaggccctgcggggtacacgagcggcgaacgggcgagtaacacgtgagcaagctgccctccacttcgggataaccatcggaaacggtggctaatactggatatgaccttgccacgcaagtggtggggtggaaagttctggcggtggaggatgtgctcgcggccaatcagcttgttggtgaggtactggctcaccaaggcttcgacgggtagccggcctgagagggtgaccggccacactgggactgtgacacggcacagactcctacggaaggcagcagtgtggaatgttggacaatgggcgaaagcctgatccaggaacgccgcgtgaggggtgactgccttcgggttgtaaacctctttaagtaccgacgaagcgagagtgacggtaggtacagaagaagcaccggccaactacgtgccagcagc

SEQ ID NO: 5043 - DNA, 490 bp, Unknown
  Ascusbbf_1347313, encodes 16S rRNA
agagtttgatcctggctcaggataaacgctggcggcgcacataagacatgcaagtcgaacggacttaactcattattaacgattgagtgcggttagtggcggactggtgagtaatgtataagtaacctgcctatcagaggggaacaacagttggaaacgactgctaataccgcatatgccacgagaatcacatgggtcaagtgggaacggagcagtccgctgataaatggacttatatctgattagctagtgggtggggtaacggcctaccaaggcgacgatcagtagccggactgagtggtgaaaaggccacattgggattgggaaacggcccagactctaacggaaggaagcagagggaaaaatggcgaaatggaggaaactctaacgaagtgaggcggcgggcaggaagaaggtttccggattgtaaactgctttagacagggaagaaaaaagacagtacctgtagaagaagcaccggctaactacg

SEQ ID NO: 5044 - DNA, 490 bp, Unknown
  Ascusbbf_1324163, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatctaaccttccccttagtagggcatagcccggcgaaagtcgtattaataccctatgttttccgttgaggatatctgaagtggaacaaagatttatcgctaagggatggggatgcgtctgattaggttgttggcggggtaacggcccaccaagccatcgatcagtaggggttctgagagggagggcaccaacagtggtactaggacacggaccaaactcctacgggaggcagcggtgcggaatagtggtcaatgggcgagagccagaaccagccaagtagcgtgaaggatgacggccctatgggttgtaaactgcttttgcatgggaataaagtgagggaggtgtccagttgtgtatgtaccatgagaat

SEQ ID NO: 5045 - DNA, 486 bp, Unknown
  Ascusbbf_1377590, encodes 16S rRNA
agagtttgatcatggctcagaacgaacgctggcggcaggtcttaggaaggaaaggagaaaggaagaaagtgtggcttgaaagggggaacggaggggcggagcactgaggaaagagggggaaagggggagggaagggggaagaagggctgtaaagggaagagaagaacgcatacgccgggaaggggaaagattgttcggtgatggatgtgcccgcgttggattagcttgttggtggggtaatggcctaccaaggcgatgatccatagctggtctgagaggacgatcagccacgctggaactgagacacggtacctcctcctacgggaggcagcagctaagaatattgggcaatggaggaaactctgacccagccatgccgcgtgaatgaagaaggccttcgggttgtaaagttcttttagtcatgaagatgatgaccgtagtgacagaaaaagcaccggctaacttcgtgcccgcagccgcggtaat

SEQ ID NO: 5046 - DNA, 490 bp, Unknown
  Ascusbbf_1377604, encodes 16S rRNA
agagtttgatcctggctcaggataaacgctagctgcgcgcttaacacatgcaagtcgaaggaccttaatcggatgtctaccttactttggcttcgacccgcacacgtgtgagtcacgcgtgtcctcccttcctctgagtggaacataaccgagcaatcatcggaataataccctatgttctgcgtctcgcacatctgaagtagagcagaagctattcgctgatagatgagcatgcgtctgattagttagtgggcggggtaacggcccacctagccgacgatcagtagccggactgagaggttaaacggcaacattgggactgggatacggcccagactcctacgggaggcagcagtcgggaatattgcgcaatggaggaaactctgacgcagtgacgccgcgtgcaggaagaaggttttcggattgtaaactgctttagatagggaagaaaaaaatgacggtacctatagaataagctccggctaactac

SEQ ID NO: 5047 - DNA, 490 bp, Unknown
  Ascusbbf_1445886, encodes 16S rRNA
agagtttgatcctggctcaggatgaacgctagcgataggcctaacacatgcaagtcgaggggcagcacatgaagtagcaattcttattgtcgcgaccggcgcacgggtgagtaacgcgtctgcaacctgcctccaacacgggaataacccgttgaaagacggactaataccccataacacagggatcccgcatgggaatatttgttaaagattaatcggttgtagatgtgcgtgcgttccattagcttgttggtgcggtaacgactcaccacggccacgatggataggggaactgagaggtaggtcaccaacagtgggactggaaaccggaccagaatccgccgggaggaagcagtgaggaagattggtcaatggagggaaggctgaaccagccacgtagcgtgaaggaagacggccctacgggttgtaaacttcttttgtaagagaataaagtggaggacgggtactattttgcatgtaccttacgaat

SEQ ID NO: 5048 - DNA, 486 bp, Unknown
  Ascusbbf_1377589, encodes 16S rRNA
agagtttgatcctggctcagaacgaacgctggcggcatgtcttaggcatgcaagtcgaacggacgtcagagttccttgccattctaatgtcagtggcgcacgtgagggttacgcgtgctaccctcccctttactggggaataccgtctggaaacggacgctaataccccatacgcccgcctggtgcgagatttatcggtgatggctgtgctgacgttggtttagcctgttggtggggcagaggcctaccaaggcgttggtccatagctggtctgcgaagacgaccagccacgctagaagtgggagacgggccagagtcctacgggagggagcagggatgaagatggaacaacggaggaaacacggagccagtcagaacgcgaaaatgaagagggcctgcggatcgtaaagttcttttagacaggaagaggatgacagtagggacagaagaagcaccggctaactacgtgccagcagccgcggtaat

SEQ ID NO: 5049 - DNA, 490 bp, Unknown
  Ascusbbf_1480771, encodes 16S rRNA
agagttgatcctggctcagaacgaacgctggcggcaggcctaacacatgcaagtcgagcgcaccttcgggtgagcggcggacgggtgagtatcgcgtgggaacgtgcccttctctacggaatagtcctgggaaactgggggtaataccgtatacgcccttttggggaaagatttatcagagaaggatcggcccgcgttggattaggtagttggtggggtaatggctcaccaagccgacgatccatagctggtttgagaggatgatcagccacactgggactgagacacggcccagactcctacgggaggcagcagtggggaatattggacaatgggcgcaagcctgatccagccacgccgcgtgagtgatgaaggccttcgggtcgtaaagctctgtggggagggacgaaccgctgcaggttaatagtctgcagcatgacggtacctccttagcaagcaccggctaacttcgtgccagcagccgcggtaa

SEQ ID NO: 5050 - DNA, 490 bp, Unknown
  Ascusbbf_834301, encodes 16S rRNA
agagtttgatcctggctcaggacgaacgctggcggcgtgcttaacacatgcaagtcgagcggtaaggcctccttcggggggtacacgagcggcgaacgggtgagtaacacgtgagtaatctgcccttcactctgggataagcaccggaaacggtgtctaataccggatacgaccaactgtcgcatggtgtgttggtggaaagttttttcggtgggggatgtgctcgcggcctatcagcttgatggtggggtaatggcctaccatggcgtcgacgggtagccggcctgagagggtgaccggtcacactgggactgagacacggcccagactcctacgggaggcagcagtggggaatattggacaatgggcggaagcctgatccagcaacgccgcgtgagggatgacggccttcgggttgtaaacctctttcatcaccgacgaagtccttgcttttggggtgggggtgacggtaggtggagaagaagcaccg

SEQ ID NO: 5051 - DNA, 477 bp, Unknown
  Ascusbbf_1430337, encodes 16S rRNA
agagtttgatcctggctcagaacgaacgctggcggcaggcttaacacatgcaagtcgaacgggcgtagcaatacgtcagtggcagacgggtgagtaacgcgtgggaatctacccagtggtttggaataactcagggaaacttgagctaataccggatacgcccttcgggggaaagatttatcgccattggaagagcccgcgtcggattagctagttggtggggtaatggcccaccaaggcgacgatccgtagccgacctgagagggtgatcggccacattggaactgagacacggtccaaactcctacgggaggcagcagtaaggagttttcggcaatgggggaaaccctgaccgagcaacgccgcgtgagggatgacggccttcgggttgtaaacctcttttagcagggaagaagcgagagtgacggtacctgcagaaaaagcgccggctaactacgtgccagcagccgcggtaat

SEQ ID NO: 5052 - DNA, 482 bp, Unknown
  Ascusbbf_1606103, encodes 16S rRNA
agagtttgatcctggctcaggacgaacgctggcggcgtgcctaatacatgcaagtcgagcggtaaggccccttcgggggtacacgagcggcggacggctgagtagcgcgtaggaacgtaccccaaagtgagggataagcaccagaaatggtgtctaataccgcatgtgatccacggattaaagccttgtgcgctttgggagcggcctgcgtatgattagcttgttggtgaggtaaaagctcaccaaggcgacgatcattagctggtctgagaggatgatcagccagactgggactgagacacggcccagactcctacggggggcagcagtagggaattttgcgcaatgggcgaaagcctgacgcagcaacgccgcgtgatcgtagacgcccttcggggtgtaaagatctgtcagtagggacgaacaatgactgtacctacagaggaagcaccggctaactccgtgccagcagccgcggtaat

SEQ ID NO: 5053 - DNA, 490 bp, Unknown
  Ascusbbf_1421555, encodes 16S rRNA
agagtttgatcctggctcaggatgaacgctggcggcgcgcctaacacatgcaagtcgaacgattaaagcaccttcgggtgtgtataaagtggcgaacggctgagtaacacgtgggcaacctacccttcactctgggatagccacgggaaaccgtgggtaataccggatactccgtgcacaccgcatgatgagcacgggaaagcgcatacggtgaaggatgggcccgcggcctgttagcttgttggtggggtaacggcctaccaaggcaattatgggtagctgggttgagagaccgaccagccagattgggactgagacacggcccagactcctacgggaggcagcagtggggaatcttgcgcaatgggcgaaagcctgacgcagcgacgccgcgtgcgggatgaaggccttcgggttgtaaagcactttcagagggaaggaacaaatgacgttaccctcagaagaagcaccggctaactccgtgccagca

SEQ ID NO: 5054 - DNA, 154 bp, Unknown
  Ascusbbf_1329020, encodes 16S rRNA
agagtttgatcctggctcagggcatcacaacgatagccggcagcatcagcgatgaagaccaacaagtgcccattcatgtggaggctcaggagaaatccgaggaggagatagccaatcagattatcttcagcgaccctgccagcagccgcgtaat

SEQ ID NO: 5055 - DNA, 357 bp, Unknown
  Ascusbbf_897990, encodes 16S rRNA
agagtttgatcctggctcaggacgaacgctggcggcgtgcctaatacatgcaagtcgtacgcttctatttccaccggagcttgctccatcggaaaaagaagagtggcgaacgggtgagtaacacgtgggtaacctgcccatcagaaggggataacacttggaacctacgggaggcagcagtagggaatcttcggcaatggacgaaagtctgaccgagcaacgccgcgtgagtgaagaaggttttcggatcgtaaaactctgttgttagagaagaacaaggatgagagtaactgttcatcccttgacggtatctaaccagaaagccacggctaactacgtgccagcagccgcggtaat

SEQ ID NO: 5056 - DNA, 490 bp, Unknown
  Ascusbbf_912071, encodes 16S rRNA
agagtttgatcatggctcaggatgaacgctggcggcgtgcttaacacatgcaagtcgaacggacaaagaagatttcggttttctttgttagtggcgaacgggtgagtaacgcgtgagtaacctgccctggagtgggggacaacagttggaaacgactgctaataccgcataagcccacagtgccgcatggcacagcgggaaaaggatttattcgcttcaggatggactcgcgtccaattagctagttggtgaggtaacggcccaccaaggcgacgattggtagccggactgagaggttgaacggccacattgggactgagacacggcccagactcctacgggaggcagcagtgggggatgttgcacaatgggggaaaccctgatgcagcgacgccgcgtggaggaagaaggttttcggattgtaaactcctgtcgttagggacgaatcatgacggtacctaacaagaaagcaccggctaactacgtgcca

SEQ ID NO: 5057 - DNA, 186 bp, Unknown
  Ascusbbf_953250, encodes 16S rRNA
agagtttgatcctggctcagacacccttcgtcaaccagcagacaggtcgcttcgacgtagcacagctcacgaagttcctcaacgattacaagtcaaaccagaacccgcagctggccgagcagtacaaggccatctacgactactggcgcttcatcgagaagaccctgcgccagcagccgcggtaat

SEQ ID NO: 5058 - DNA, 166 bp, Unknown
  Ascusbbf_1546535, encodes 16S rRNA
agagtttgatcctggctcaggacttccgcatcaagggcagtcacgactatgtatatggtctgcctgagattaataaggaagagattatgaaagctcagcatttggctaatccaggctgtttcgccacttgtattcaggtagcgttgctgccagcagccgcggtaat

SEQ ID NO: 5059 - DNA, 170 bp, Unknown
  Ascusbbf_953261, encodes 16S rRNA
agagtttgatcctggctcagtatcgttggaagagggattggtgctgaccgaccacattgctggtgcgctcctctctcatggaccgaaacgtatgaactatatcctgatggctctctgccagcggggtgaggcacgctatgcgattgacacccgccagcagccgcggtaat

SEQ ID NO: 5060 - DNA, 343 bp, Unknown
  Ascusbbf_870932, encodes 16S rRNA
agagtttgatcatggctcagaccggtactctgggcaccaattcccagacgggcaccgttcatcagggacatcacgtacttaatcaggcccagacgggtgctgccgcacagctcggcacgcgcgttcttataggtaagctcgcaggtcgggctgccgtggataccgagtttgtgctcgatgtgacggacattcacgccaccctggcgcttgtcatagataaacatggaaaggccgcggccatcgcgggtaccttcctcactgcgggccaggaccaggtggatatcggagtcaccgttggtgatgaaacgcttcacaccgttcagcagccagcagccgcggtaat

SEQ ID NO: 5061 - DNA, 490 bp, Unknown
  Ascusbbf_783437, encodes 16S rRNA
agagtttgatcatggctcaggatgaacgctagcggcaggcctaatacatgcaagtcgaacggtaaatgtcccttcggggatatgagagtggcgcacgggtgcgtaacgcgtatgcaacccacccgctgtcgggggatagcccgtagaaatgcgaattaataccccatgaggagaaagggcggcatcgtacttttttcaaaactttggtgacggcggacgggcatgcgtggcattagatagttggcggggtaacggcccaccaagtcgacgatggctaggggatctgagaggacggtcccccacactggtactgagacacggaccagactcctacgggaggcagcagtaagggatattggtcaatggggggaaccctggaccagccatgccgcgtgaaggaagacggtcctctggattgtaaacttctgttgttagggaagaacggtaagtataggaaatgatacttaagtgacggtacctttcaagaaag

SEQ ID NO: 5062 - DNA, 488 bp, Unknown
  Ascusbbf_1646256, encodes 16S rRNA
agagtttgatcctggctcagaacgaacgctggcggcaggcttaacacatgcaagttgaacgggatttatttagtacttgtactggatgatgagagtggcgcacgggtgagtaatatgtaggaacatacctattggtcgggaataacggttggaaacgacaggtaataccggataagccctgagggggaaagatttatcgccgatagaatggcctgcatcagattaggcagttggtggggtaaaggcctaccaaaccgacgatctgtagctggtctgagaggacgatcagccacattgggactgagacacggcccagactcctacgggaggcagcagtgaggaatattgggcaatgggggcaaccctgacccagccatgccgcgtgagtgaagaaggttttcggattgtaaagctctttcggatgtgacgatgatgacggtagcatctaaagaagccccggcaaacttcgtgccagcagccgcggtaat

SEQ ID NO: 5063 - DNA, 490 bp, Unknown
  Ascusbbf_1365736, encodes 16S rRNA
agagtttgatcctggctcaggatgaacgctggcggcgtgcttaacacatgcaagtcgagcgagaaatcgggaaatgaaacttcggtagatttgaacgatggaaagcggcggacgggtgagtaacacgtgggaaacctgccttttgcagagggacagccgagggaaacttcgattaatacctcataacgcatcatcgtcgcatggcggagatgccaaagatttatcggcaagagatggtcccgcgtctgattagctggttggtgaggtagcggctcaccaaggcgacgatcagtagccggcctgagaggataaacaatcacattaaaactaaaacacaatccaaactcctacaaaaaacaacaataaaaaatattacacaataaacacaaacctaatacagcaacgccgcgtgaaggatgaaggccttcgggtcgtaaacttctgtccaaagggaagaacaaatgacggtacctttggaggaagccccggc

SEQ ID NO: 5064 - DNA, 490 bp, Unknown
  Ascusbbf_1245359, encodes 16S rRNA
agagtttgatcatggctcaggatgaacgctggctacaggcttaacacatgcaagtcgaggggcatcgcatggggttgctcgcaactcctggcggcgaccggcgcacgggtgagtaacgcgtatccaacctgccccgtggtagggtatagcccggtgaaaaccggattaatcccctatgcggtcacgagacggcatccgaccgtgaccaaaggacttccgccatgggatggggatgcgtctgattaggtagtagacggggcaacggcccacctagccgtcgatcagtaggggttctgagaggaaggtcccccacattggaactgagacacggtccaaactcctacgggaggcagcagtgaggaatattggtcaatgggcgatggcctgaaccagccaagtagcgtgagggacgacggccctacgggttgtagacctcttatatgcggggataaagtcactcacgcgtgggtgtttgcaggtaccgcatgaa

SEQ ID NO: 5065 - DNA, 490 bp, Unknown
  Ascusbbf_1409279, encodes 16S rRNA
agagtttgatcatggctcagaacgaacgctggcggcaggcttaacacatgcaagtcgaacgatctcttcggagatagtggcagacgggtgagtaacacgtgggaatctacctggttcttcgggataactgatggaaacgtcagctaataccggatacgcccttttggggaaagatttatcggaatcagatgagcccgcgtaagattagctagttggtggggtaacggctcaccaaggcgacgatctttagctggtctgagaggatgatcagccacactgggactgagacacggcccagactcctacgggaggcagcagttagggatattcgtcaatgggggaaaccctgaacgagcaatgccgcgtgagtgatgacggtcttatagattgtaaaactctgttgtaaaggaagaaaccttattataggtaatgataataagttgactgtactttaccagaaagccccggctaactacgtgccagcagccgc

SEQ ID NO: 5066 - DNA, 151 bp, Unknown
  Ascusbbf_1652934, encodes 16S rRNA
agagtttgatcatggctcagcctggctggatatcatccagtccatcagcctggcgttttcgagccgggcggctgccctcggcatgatcatcatgctcatcggcggcttttcgatgtatatggataagatcggtgccagcagccgcggtaat

SEQ ID NO: 5067 - DNA, 155 bp, Unknown
  Ascusbbf_1643892, encodes 16S rRNA
agagtttgatcctggctcagcaggatttcgctctgcagccgcggggccagtgtatccaccagctcccggcaaatctcaggccgccgctccgccggcacatcctgccagcgcccagcgtactggtcacgtacctgctcgccagcagccgcggtaat

SEQ ID NO: 5068 - DNA, 490 bp, Unknown
  Ascusbbf_1608754, encodes 16S rRNA
agagtttgatcctggctcaggatgaacgctagctacaggcttaacacatgcaagtcgaacgaagcttgagaacagaattcttcggaaggacgtttgatatgactgagtggcggacgggtgagtaacgcgtgagcaacctgcccttcggagggggatagtgtctggaaacggacagtaataccgcataatgttggatgatggcatcttcattcaaccaaagatttatcgccgaaggatgggctcgcgtctgattagatagttggtggggtaacggcctaccaagtcgacgatcagtagccggactgagaggttgaacggccacattgggactgagacacggcccagactcctacgggaggcagcagtggggaatattgcacaatgggcgcaagcctgatgcagcaacgccgcgtggaggaagacggttttcggattgtaaactgctttagatagggaagaaaaaaaatgacggtacctatagaataagctc

SEQ ID NO: 5069 - DNA, 490 bp, Unknown
  Ascusbbf_1679199, encodes 16S rRNA
agagtttgatcctggctcaggacgaacgctggcggcgtgcctaacacatgcaagtcgaacgaagcactggaaatgattccttcgggttgattttcctttaactgagtggcggacgggtgagtaacacgtgagcaacctgcctttcagagcgggatagcagttggaaacaactgataataccgcatgacatgttttctccacatgaggaaaacatcaaataatttttcgctgaaagatgggctcgcgtccgattaaataattggtgagacaacggctcaccaagccgacgatcggtagccggactgagaggtcgatcggccacattaaaactaaaacacggcccagactcctacgggagacagcaatgaaaaatattgcacaataaacgcaaacctaatgcagcaacgccgcgtgagggaggacggtcttcggattgtaaacctctgtccttggggaagaaacaaatgacggtacccttggaggaagccac

SEQ ID NO: 5070 - DNA, 490 bp, Unknown
  Ascusbbf_1378008, encodes 16S rRNA
agagtttgatcctggctcaggacgaacgctggcggcgtgcttaacacatgcaagtcgaacggtaaggccccttcgggggtacacgagtggcgaacgggtgagtaacacgtgggtaatctgccctgcacttcgggataagcctgggaaactgggtctaataccggatatgaactccttccgcatggtgggggttggaaagtttttcggtgcaggatgagcccgcggcctatcagcttgttggtggggtaatggcctaccaaggcgacgacggatagccggcctgagagggtgatcggccacacgggaattgggaaacggcccagatcgcgacggggggaagcagtggggaatattgctcaatgggcgaaagcctgttgcggcgacgccgcgtggggatgacggtcttcggattgtaaacccctttcagtagggacgaagcgcaagtgacggtacctgcagaagaagcaccggctaactacgtgccagcagc

SEQ ID NO: 5071 - DNA, 490 bp, Unknown
  Ascusbbf_1435806, encodes 16S rRNA
agagtttgatcctggctcaggataaacgctggcggcgcacataagacatgcaagtcgaacgaacttaatcgaaagtttacttttgacgcggttagtggcggactggtgagtaacgcgtaagcactctgcctatcagaggggaataacagtgagaaatcattgctaataccgcataagctgtgagtatcgcatgatacaaacagaaaaggagcaatccgctgatagaggggcttgcgtctgattagttagttggtggggtaacggcctaccaaggcgatgatcagtagccggactgagtggttaagagggcacagtgggaatgagatacggcccagacacctaggggaagcggcgatcgggaggaaggcggaatggaggaaactctgacgtagtgacaccgcgtgcaggaagaaagttttcgggttgtaaacggcattagagagggaagaaaaaaaatgacggtacctaaagaataagcaccggctaacta

SEQ ID NO: 5072 - DNA, 486 bp, Unknown
  Ascusbbf_1321601, encodes 16S rRNA
agagtttgatcatggctcagaacgaacgctggcggcaggtcttaggcatgcaagtcgaacggacgacagagtggcttgccattctgaagttagtggcgcacgagtgagtcacgcgtgggaaactgcccttcactggggaataacgtctggatacggacgctaataccgcatacgcccgccaggggaaagatttatcggttatggttgtgcccgggtcggattagcttgttggtggggtaatggcctaccaaggcgatgagccatagctggtctgagaggacgatcagccacgcgggaactgagacacgggccagactcctacggggggcagcagctaagaatattgggcaatggaggaaactctgacccagccatgccgcgtgaatgaagaaggcctgcggggtgtaaagttcttttagtcatgaagatgatgacagtagtgacagaaaaagcaccggctaactgcgtgccagcagccgcggtaat

SEQ ID NO: 5073 - DNA, 490 bp, Unknown
  Ascusbbf_1321923, encodes 16S rRNA
agagtttgatcatggctcaggacgaacgctggcggcatgcttaacacatgcaagtcgaacggactgattccttcgggttgaaagttagtggcgaacgggtgagtaatgtatgagcaacctgcctctatcaacgggataacagttggaaacgactgttaatacggtataagactacggcaccgcatgatgttgcggtaaaagatttttcggatagagatgggctcatatcccattggctagttggtgagataacagccaaccaaggcgacgatgggtagccgagctgagaggctgatcggcgacaatgggactgagacacgacccagacgcctacgggaggcagcagtggggaatattgggcaatgtaggcaactctgacccagcaatgccgcgtgagtgatgaaggtaattttattgtaaagctcttttctcaggaacgaataaagatgacggtacctgaggaataagccccggctaactacgtgccagc

SEQ ID NO: 5074 - DNA, 486 bp, Unknown
  Ascusbbf_1372186, encodes 16S rRNA
agagtttgatcatggctcagaacgaacgctggcggcaggtcttacacatgcaagtcgaacggacaacggagtagcttgccattctgactttcgtgtcgcgcgcgtgagtaacgcgtgggaaactccccttcactggggaatatcgtgtggcaacggaccctaataccgcacacgcccccaaggggaaagagttatcggtggtgggtgtgcccgcgaccgattagcttgttgtgggagtagtggcctaccaaggcgatgatccatagctgggctgagaggacgatcggccacgctggaacggggacaaggagcagagtcctacgggaggtagcagaaaagaagattgggcaatggagggaactcggagcaagccatgccgcgggaatgaagaaggccattggggggtaaaggtatgttagtcatgaagatgatgaaagtagggacagaaaaagcaccggccaacctcgtgccagcaggcggggtaaa

SEQ ID NO: 5075 - DNA, 490 bp, Unknown
  Ascusbbf_1321625, encodes 16S rRNA
agagtttgatcctggctcaggatgaacgctagcggcaggcttaacacatgcaagtcgaggggtaacgcggggtagcaagactctggcgacgaccggcgcacgggggcgtaacgcgtatgcaaccgacctgtaacagggggagaacggagagaaaggtccactaatcccccatatggttagagattcgcaggtgtctcgaacgaaagcttcggtggtgacggatgagcatgcgggacattagctagttggtaaggtaacggcgtaccaaggcgacgatgtctaggggcgctgagaggcttagccccccccccgttcctgcgcccccgcccagcctcctccgcgaggcagcagtgtcgactattggtccatggacggaagtctgaaccagccatgccgcgtggaggcagacggtcctatgggttgtaacctccttttgttcgagagtaatacgaggcttgcgcgcctcgatgagcgtatcggacgaataagc

SEQ ID NO: 5076 - DNA, 490 bp, Unknown
  Ascusbbf_1372198, encodes 16S rRNA
agagtttgatcctggctcaggatgaacgctagcggcaggcttaacacatgcaagtcgaggggtaacgcggggtagcactactctggcgacgaccggcgcacgggtgcgtaacgcgtatgcaacctacctgtaacaggggtataacggagagaaatttccactaatcccccatattgttagagattcgcatgtttctctatcgaaagcttcggtggttacggatgggcatgcttgacattagctagttggtaaggtaacgacttaccaagtcgacgatttctaggggagctgagagacttatccccctgactgggacagagacacggcccagactcctgaggcaggaggcagtgaggaatagtggtcaatggaaggaagtctgaaccagccaggccgcgtggaggaagaaggtgctatgggttgtaaactccttttgttcgagagtaataagaggcttgcgagcctcgatgagagtatcggacgaataagc

SEQ ID NO: 5077 - DNA, 486 bp, Unknown
  Ascusbbf_1372179, encodes 16S rRNA
agagtttgatcctggctcagaacgaacgctggcggcaggtcttaggcatgcaagtcgaacggacgacagagtggctcgccattctgaagttagtcgcgcacgcttgtgtaacgcgcgggaaactgctcttcactggtggataatgaccggaaacggaccctcataccgcatccacccgcacggggaaacatttctcggtggtggatgtgcttgctatggattagctcgtcggtggggtaatggcctaccaaggcgatgatccatacctggtctgagaggacgatcagccacgctggaactgagacacggtccagactgctacggggggcagcagctaagaatattgggcaagggaggagactccgagccagccatgcagcgggaatgaagaaggccttcgggtgggaaagttcttttagtcatgaagatgatgacagtagtgacagaaaaagcaccggctaactccgtgccagcagccgcggtaat

SEQ ID NO: 5078 - DNA, 490 bp, Unknown
  Ascusbbf_1321932, encodes 16S rRNA
agagtttgatcctggctcaggatcaacgctggcggcgtgcctaatgcatgcaagtcgaacggggtggccttcgggtctcttacgtggcggacgggtgaggcacacgtgggcaacctgcctgttggagggggctaaccgctgggaacagccggtaataccgcataatcctggatctcgtgtgggagatctggggtcagtcgaaaaacgccgaccgaccgccctgcgtccgattagctagacggtggggtaacggcctactgtcgacgtgctcggtagctggtttgagaggatgatcagccacacggggactgggaaagggccacgactcctacgggaggcagcagcaaggaagtttccgcaatgggcgaaagcctgacggagcaacgccgcgtgtgggatgacgcttttcggagtgtaaaccactgttcgtggggacgaagcactgacggtacccacggaggaaggcccggctaactacgtgccagcagcc

SEQ ID NO: 5079 - DNA, 486 bp, Unknown
  Ascusbbf_1343839, encodes 16S rRNA
agagtttgatcctggctcagaacgaacgctggcagcaggtcttaggcatgcaagtcgaacggacgacagagtggctttcccttctgtagttagtgtcgcacgagtgcgtaacgcgtgtgaaactgcccttcactggggaataacgtctggacgcggacgctaataccgcatacgcccgcccggggaaagatttatcggtgatggatggaccggcgtttggttggctttttggtgtggtaatggcctaccaaggcgatgatccatagctggtcttagaggacgatcagccacgctggaactgggacacggtccagactcctacgggaggcagcagctaagaatattgggcaatggaggaaactctgacccagccatgccgcgtgaatgaagaaggccttcggggtgtaaagttctttgaggcatgaagatgatgacagtaaggacagaaaaagcaccggctaacttcgtgccagcagccgcggtaat

SEQ ID NO: 5080 - DNA, 490 bp, Unknown
  Ascusbbf_1372156, encodes 16S rRNA
agagtttgatcctggctcagaacgaacgctggcggcatgcctaacacatgcaagtcgaacgagacctccgggtctagtggcgcacgggtgcgtaacgcgtgggaacctgcccttaggttcggaataactcctcgaaaggggtgctaataccggataatgtcttcggaccaaagttttatcgcctttggatgggcccgcgtcggattctccagttgttggggtaagggctcaccagggggagaagcccgagctggtcttggaggatcataagccaaactgggactgagacacggaacatcggcctgcgaaacggcgcagactgcaacggggggcagcagaggggagtattagccaacgagggagagcctgatacggaaatgccgcgtgagggatgaaggctttagggttgtaaagctcttgtaccagggatgataatgacagtacctggagaataagctccggctaactccgtgccagcagccgcggtaat

SEQ ID NO: 5081 - DNA, 490 bp, Unknown
  Ascusbbf_1435810, encodes 16S rRNA
agagtttgatcatggctcaggataaacgctggcggcgcacataagacatgaaagtagaaaggacttaatgaatgagtaaggattgagagaggggaggggaggaagggtgagtaagggagaaggaaaagggagagaagaggggaaaaaaagggggaaaagaaggagaataccgcatagggtacgagaatcacatggttcaagtgggaaaggagcaatccgctgatagatggacttatatctgattagctagttggtggggtaacggcctactacggcgacgatacgtagccggactgagaggttaaactccaccattgggactgaggtacggcccacactcctacgggaggcagaagtcgggaagattgcgaaatggaggaaactctgaggcagtgacgccgcgtgcaggaagaaggttttcggattggaaactgctttagacagggaagaaaaaagacagtacctgtagaataagctccggctaactacg

SEQ ID NO: 5082 - DNA, 490 bp, Unknown
  Ascusbbf_1372205, encodes 16S rRNA
agagtttgatcctggccaggacgaacgctggcggcatgcttaacacatgcaagtcgaacggactgattccttcgggatgaaagttagtggcgaacgggtgagtaatgtatgagcaacctgcctctgtcaacgggataacagttggaaacgactgctaatacggtataagaccacggcaccgcatggtgctgcggtaaaagatttttcggacagagatgggctcatatcccattagctagttggtgagataatagcccaccaaggcgacgatgggtagccgagctgagaggctgatgggccacgttgggaatgaaacagggccacggcaccgacggaaggcagcagtggggaaggttgggcaatggaggaagctctgactcagcaatgccgcgtgagcgatgaaggtaattttattgtaaagctattttctcaggagcgaataaagatgacggtacctgaggaataagccccggctaactacgtgccagca

SEQ ID NO: 5083 - DNA, 472 bp, Unknown
  Ascusbbf_1343844, encodes 16S rRNA
agagtttgatcatggttcagagcgaacgctggcggcatgcttaacacatgcaagtcgcacgaaggtttcggccttagtggctgacgggtgagtaacgcgtaggaatctatccatgggtgggggatcactctgggaaactggagctaataccgcatgatacctgagggtcaaaggcgcaagtcgcctgtggaggagcctgcgttcgattagcttgtggggggggtaatggcctaccaaggcgatgatcgatagctggtctgcgaggatgatcagccacactgggactgagacacggcccagactcctacggggggaagcaggggggaatagtggacaatgggggcaaccctgatccagaaatgccgcgtgtgtgaagaaggttttcggagtgtaaagctctttcggcggggacgatgatgacggtacccgcagaagaagccccggctaacttcgtgccagcagccgcggtaat

SEQ ID NO: 5084 - DNA, 490 bp, Unknown
  Ascusbbf_1341354, encodes 16S rRNA
agagtttgatcctggctcaggacgaacgctggcggcgtgcttaacacgtgcaagtcgaacgaagcactgaaatggatttcttcggaatgatggggcggggaccgagtggcggacgggtgagtaacacgtgagcaaccggccgtgcagagcgggagagcagtgggaaacggcggagaataccgcatgacatgtgttctccgcatgaggaaaacatcaaatgattcttcgctgaaagatgggctcgcgtccgattaggtagttggtgaggcaacggctcaccaagccgacgatcggtagccggactgcaaggtcgatcgcccccattgggactgggacacggcccaggcgcctacgggaggcagcagtgggggatattgcacaatgggcgcaagcctgatgcagcaacgccgcgtgggggaggacggtcttcggattgtaaacctctgtccttggggaagaaacaaatgacggtacccttggaggaagccac

SEQ ID NO: 5085 - DNA, 490 bp, Unknown
  Ascusbbf_1436385, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttagagattcgcatgtttctctaacgaaagcttcggtggttacggatgggcatgcgtgacattagctagttggtaaggtaacgacttaccaaggcgacgatgtctaggggagctgaaaggcttatcccacaggaaggtacagaggcacggaccagactcgtgcgggaggcagggggaatgaagatgagtggatggacggaagtctgagccaggcaggccgcgtggaggaagaaggtgctatgggatgtaaactccttttgttcgagagtaataagaggcttgcgagcctcgatgagagtatcggacgaataagc

SEQ ID NO: 5086 - DNA, 490 bp, Unknown
  Ascusbbf_1321568, encodes 16S rRNA
agagtttgatcctggctcaggatgaacgctagcggcaggcttaacacatgcaagtcgaggggtaacgcggggtagcaatcctctggcgacgaccggcgcacgggtgcgtaacgcgtatgcaacctacctgtaacaggggtataacggagagaaattttcactaatcctccatattgcttgagattcgcatgtttctctaacgaaatcttcggtggttacggatggacttgcgtgactttggctggttggtaaggtaacgacctaccaaggcgacgatttctaggggggctgagaggcttatcccccagactggtactgggccacggaccagactccgccgggaggcagcagtgaggaataatggtcaatggacggaagtctgaaccagccatgccgcgtggaggaagaaggtcctatgggttgtaaactccttctgttcgagagtaataagaggcttgcgagcctcgatgagagtatcggacgaataagc

SEQ ID NO: 5087 - DNA, 490 bp, Unknown
  Ascusbbf_1371565, encodes 16S rRNA
agcgtttgatcatggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttagagattcgcatgtttctctcacgaaatcttcggtggttactgatgggcttgcgtcacattagctagttggtacggtaacggcttaccatggcgacgatgtctaggtgagctgaaaggcttatcccctaaactggtactgagacacggaccagactcctacgggaggcagcagtgagaaatagtggtcaatggacggaagtctgaaccagccatgccgcgtggaggaagaaggtcctatgggtggtaaactccttgtgttcgagagtaataagaggcttgcgagcctcgatgagagtatcggacgaataagc

SEQ ID NO: 5088 - DNA, 486 bp, Unknown
  Ascusbbf_1371609, encodes 16S rRNA
agagtttgatcctggctcagaacgaacgctggctgcaggtcttaggcatgcacgtcgaacggacgacagagtggcttgtcattctgaagttagtggcgcacgagtgagtaacgcgtgggaaactgcccttcactggggaataacgtctggaaacggacgctaataccgcatactcccgcaaggggaaagatttatagttgatggatttgcccgcgttgcattagcttgttggtgggttaatttcctaccaaggcgatgatccatagctggtctgagaggccgagaatccacgctgaaactgagacacggtccagactcctacgggaggcagcagctaagaatattgggcaatggaggaaacgctgacccagacatgccgcgtgaatgaagaaggccttcgggttgtaaagttcttttagtcatgaagatgatgacagtagtgacagaaaaagcaccggctaacttcgtgccagcagccgcggtaat

SEQ ID NO: 5089 - DNA, 490 bp, Unknown
  Ascusbbf_1436552, encodes 16S rRNA
agagtttgatcatggctcagaacgaacgctggcggcgcgctttaagcatgcaagtcgagcggcaaggacttcggtccccagagcggcggacgggtgagtcacacgtggataatctgccctgcagtctggaataccccatggaaacatgggctaatgccggatgcgagatggaggcgatggtctttatgggaaagctcccacgggagcgctgcaggatgagtccgcggccgattagctagatggcggggtaagggcccaccatggcgacgatgggtagccggcctgagagggtggtcggccgcataggaacggagtaacggacgggacaactacggaaggcagccgctagggatcattcacgatgaacggaagtctgattgagcgaggccgggtgggcgatggaggccggaaggttggatagtacattgatggagggagaagaaccgcttcagggaatgggagcggtaggacgtgaatccatgaataagcc

SEQ ID NO: 5090 - DNA, 490 bp, Unknown
  Ascusbbf_1371562, encodes 16S rRNA
agagtttgatcctggctcaggacgaacgctggcggcatgcttaacacatgcaagtcgaacggactgattccttcgggatgaaagttagtggcgaacgggtgagtaatgtatgagcaacctgcctctgtcaacgggataacagttggaaacgactgctaatacggtataagaccacggcaccgcatggtgcggcggtaaaagattgttcggacagagaggggctcacataccattagcgagtgggtgagataatagcccaccaaggcgacgatgggtagccgagctgagcggctgatcggcacaatggggactgaaacacggccccgcctcctacggcaggcagcaatggggaatattgggcaatggaggaaactctgacccagccatgccgcgtgagcgatgaaggtaattttattgtaaagctcttttctcaggaacgaataaagatgacggtgcctgaggaataagccccggctaactacgtgccagc

SEQ ID NO: 5091 - DNA, 486 bp, Unknown
  Ascusbbf_1321616, encodes 16S rRNA
agagtttgatcctggctcagaacgaacgctggcggcagggctgaggcatgcaagtcgaacggacgacagagtggcttgccattctgaagttagtggcgcacgagtgagtaacgcgtgggaaacggcccttcactggggaagaacgtcgggaaacggacgctaagaccgcagacgcccgcaaggggaaagagctaccggggatggaggggcccgcgtgggattagcttgtggggggggtaagggcctaccaaggcgaggatccatagctggtctgagaggacgatcagccacgctggaacggagccacggtccagcctcctccgggcggccgctgctccgactcttgggcactggaggacactctgcccccgccctgccgcgtgaatgaagccggccttcgggttgtaaagttcttttagtcatgaagatgatgacagtagtgccagaacaagccccggctaacttcgtgccagcagccgcggtaat

SEQ ID NO: 5092 - DNA, 486 bp, Unknown
  Ascusbbf_1371511, encodes 16S rRNA
agagtttgatcctgactcagaacgaacgctggcggcaggtcttaggcatgcaagtcgaacggacgccagagtggcttgccattctgaagatggtggcgcacgcgtgagtaacgcgtgggaaactacccttccctggggaataacgtctggcaacgaacgctaataccgcatccgcccgccatgggaaagatttaccggagtggagtgggccggcgttggattggcatgttggtggggtaatggcataccaaggcgatgatccatacctggtctgggaggacgatcagccacgctggaactacggcagggtgcagactccaacggtaggcagcggctaagagcatggggcaacggagtaacgtgcgagacggcgaggccgtgtgaaggaagctggccttagagttggaaagttcttgtagtcatgcagatgatgacagtagtgacagaaaaagcaccggctaacttcgtgccagcagccgcggtaat

SEQ ID NO: 5093 - DNA, 490 bp, Unknown
  Ascusbbf_1341398, encodes 16S rRNA
agagtttgatcctggctcaggatgaacgctagctacaggcttaacacatgcaagtcgaggggcatcataacgaaagcttgcttttgttgatggcgaccggcgcacgggtgagtaacgcgtatccaaccttccccttagtagtgcatagcccggcgaaagtctgattaataccctatggtttcctttgatgacctctgaagtggaacaaagatttatcgctaagggatggggattcgtctgattagtttgttggcggggtaacggcccaccaaaccaacgatcagtctgggttcttaaacgaaagccaccccaaatgggtactggacaagggaccaacctcctcaggggggaagaagtgaggaatattggtcaatggcggagagcctgaaccagccaagtagagtgaaggatgacggccctatgggctgtaaactgtttttgcatgggaataaagtgagggacgtgtccctttttgtatgtaccatgagaa

SEQ ID NO: 5094 - DNA, 490 bp, Unknown
  Ascusbbf_1436380, encodes 16S rRNA
agagtttgatcatggctcaggatgaacgctagctacaggcttaacacatgcaagtcgaggggcagcatgacgattgcttgcaattgttgatggcgaccggcgcacgggtgagtaacgcgtatccaaccttccctatagtagagaatagcccggcgaaagtcggattaatgctctatgttcttctttgatggcatctgacgagaagcaacggttcacctctagaggattgggatgcgtctgattagcttgttggcggggtaacgacccgccaaggcaacgatcagtggtggttatgagaggaaggtcaccaacattggaactgagacacggtccaaactcctacgggaggcagcagtgaggaatattggtcaatgggcgagagcctgaaccagccaagtagcgtgaaggatgaaggttctatgggttgtaaacttcttttgtacggggataaagagagccacgtgtagcttcttgcaagtatcggacgaat

SEQ ID NO: 5095 - DNA, 490 bp, Unknown
  Ascusbbf_1341323, encodes 16S rRNA
agagtttgatcctggctcaggatgaacgctggcggcgtgcttaacacatgcaagtcgaacggagttatctctctgagtatagcttgctcaaatcttgagataacttagtgtcggacgggtgagcaacgcgtggataacctgccttatactgggggataacacttagaaataggtgctaataccgcataagttcacgttcccgcatgggaaactgtgaaaaactccggtggtgtaagattggtccgcgtctgattaggtagttggtgaggtaacggccaaccaagtcaacgatcagtagccgacctgagagggcgaacgacaacattgggactgagacacggcacaaacgcctacgggaggaagcagtggggaatattgcacaaggggggaaaccctgatgcagcggcgccgcgtgagtgaagaagtatttcggtatgtaaagctctatcagcaaggaagaaaaaaatgacggtacttgactaagaagccc

SEQ ID NO: 5096 - DNA, 486 bp, Unknown
  Ascusbbf_1435851, encodes 16S rRNA
agagtttgatcatggctcagaacgaacgctggcggcaggtcttaggcatgcaagtcgaacggacgacagagtggcttgccattctcaagttagtggcgcacgagtgagtaacgcgcgggaaactgcccttcactggggaataacgtctggaaacggacgctaataccgcatacgcccgcaaggggaacgatttatcggtgacagatgtgcccgcgtgggattagtgtgttgggggggtaatggcctaccaaggcgatgaaccatatctggtctgagaggacgatcagccacgctggaactgagacacggaccaggcccctacgggaggcagcagctaagaatagtgggcaatggaggaaactctgacccagccatgccgcgtgaatgaagaaggcctgcgggttgtaaagttctagtagtcatgaagatgatgacagtagtggcagaaaaagcaccggctaacttcgtgccagcagccgcggtaat

SEQ ID NO: 5097 - DNA, 490 bp, Unknown
  Ascusbbf_1435736, encodes 16S rRNA
agagtttgatcatggctcaggatgaacgctagcggcaggcttaacacatgcaagtcgaggggcagcgcggggtagcaatactctggcggcggccggcggacgggcgcgtaacgtgtgagcaacttgcccgtccctgggcggtagacactggaaacggtgtgtaatactccataacatatggattcacacgcatttatattaaatgattcgttggtgatggatgtgctcccgttacgtgatagaatgtgcgggttatgagccccccccagatacgatgtttaggggttttgagaggaaggtgctccaaactggaaatgtgacacggtccagactcttacgggaggaggcagtgaggaatattggtcaatgggcgaaagcctgaaccagccaagccgcgtgcaggaataaggccctatgggtcgtaaactgcttgtgcttgagggcaataaaggtaacgtgtggcccgatgagagtatcaggggaataagca

SEQ ID NO: 5098 - DNA, 484 bp, Unknown
  Ascusbbf_1371943, encodes 16S rRNA
agagtttgatcatggctcagaacgaacgctggcggcaggtcttaggcatgcaagtcgaacggacgacagagtggcttgccattctgaagttagtggcgcacgagtgagtaacgcgtgggaaactgcccttcactggggaataacgtctggaaacggacgctaataccgcatacgcccgcaaggggaaagatttatcggtgatgggtgtgcccgcgttggattagcttgttggtggggtaatggcctaccaaggcgatgatccatagctggtctgagaggacgatcagccacgctggaacggagcaacggccccgactcctacgggaggcagaagcaaggaatattgggcaatggaggaagctcggaccaagccatgccgcgtgaatgaagaaggccttcgggttgtaaagttcttttagtaatgaagatgatgacagtagtgacagaaaacgcaccggctaactgcgggcaagcagccgcggta

SEQ ID NO: 5099 - DNA, 490 bp, Unknown
  Ascusbbf_1371951, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccccttagtaggcaaagccccggcgaaagcgggttaataccctatttttttccgtgagggcctccgaagggggataaagatttttcgcctaaggatgggggtgcgtgtgattgggttggtgggggggaaaccgcccaccaagccatcgataagtaggggttctgggggggaggtcccccacatgggtactgagacacggaccaaactcctacgggaggcagcagtgaggaatattggtcaatgggcgagagcctgaaccagccaagtagcgtgcaggatgacggccctatgggttgtaaactgcttttgcatgggaataaagtgagggacgtgtccctttttgtatgtaccatgagaata

SEQ ID NO: 5100 - DNA, 490 bp, Unknown
  Ascusbbf_1321794, encodes 16S rRNA
agagtttgatcctggctcaggataaacgctggcggcacacataagacatgcaagtcgaacggacttaactcattcttaacgattgagagcggttagtggcggactggtgagtaatgtataagtaccctgcctatcagaggtgaacaacagttggaaacgactgctaataccgcatatgccacgagaatcacatggttcaagtgggaaaggagcaatccgcttatcgattgacgtatatctgattagctagttggtggggtaacggcctaccaaggagacgatcagtagccggactgggaggttaaacgacgacattgggactgagagacggcccagactagtaagagaggcagcaggcgggaagattgagcaatggaggaaacgctgacgcagtgacgccgcgggcaggaagaaggttttcggattgtaaactgctttagacagggaagaaaaaagacagtacctgtagaataagctccggctaactacg

SEQ ID NO: 5101 - DNA, 490 bp, Unknown
  Ascusbbf_1343951, encodes 16S rRNA
agagtttgatcatggctcaggacgaacgctggcggcgtgcttcatacatgcaagtcgaacgagaagctctagcttgctagagtggaaagtggcggacgggtgagtaatatgtaggaaatctgccctagagagggggacaacagagggaaacttctgctaataccccatatgagcttggttgcaataccaatcttgaaaactccggtgctctaggatgagcctgcatctgattagcttgttggtggtgtaatggactaccaaggcgacgatcagtagctggtttgagaggatgatcagccaacatgggacggggacacgcccattactactacggaaggcggcagtagggcattttgcgcaatgggcgaaagcctgacgcagcaacgcggcgggaatgatgaagcccttcggggtgtaaaagtctgtcagtggggacgaattttgacggtacccacagaggaagcaccggctaactccgtgccagcagccg

SEQ ID NO: 5102 - DNA, 490 bp, Unknown
  Ascusbbf_1321809, encodes 16S rRNA
agagtttgatcctggctcagaacgaacgctggcggcatgcttaacacatgcaagtcggacgggaatcgattgatagctttctattgattgagcagagtagtgcacggttgattaacacgtgggtacataccttatagtggggatcacaattggaaacgattgataataccgcatacgtcctaagggagaaaggcgcaattcgctataagagtggcccgcggaatatcaggatgttggtggggtaaaggcctaccaaacctacgccctatagctggtctgagaggacgatcagccacattaggactgagaagcggcccaaactcctacgcgaggcggcagtgaggaatattgggcaatgggggcaaccctgacccagccatgccgcgtgagtgaagaaggttttcgaattgtaaagctctttcggatgtgaagatgatgacggtagcatctaaagaagccccggcaaacttcgtgccagcagccgcggtaa

SEQ ID NO: 5103 - DNA, 365 bp, Unknown
  Ascusbbf_1321808, encodes 16S rRNA
agagtttgatcctggctcagattgaacgctggcggcaggcctaacacatgcaagtcgagcggatgaggggagcttgctccctgattcagcggcggacgggtgagtaatgcctaggaatctgcctggtagtgggggacaacgtttcgaaaggaacgctaatacctcaaacgtcctacgggagaaagcagggggccttcgggccttgcgctagcagatgagccaaggtcggattggctagttgatgaggtactggcgctcctaaagcacgataagttgggaggaagggttgtaacctaataagttgcaattttgacgttaccgacagaataagcaccggctaacttcgtgccagcagccgcggtaat

SEQ ID NO: 5104 - DNA, 490 bp, Unknown
  Ascusbbf_1371874, encodes 16S rRNA
agagtttgatcctggctcaggatgaacgctcgctccaggcttaacacatgcaagtcgaggggcagcataacgaaagcttgcttttgttgatggcgaccgtcgcacgggtgagtaacgcgtatccacccttccccttagtagggcatagcccggcgaaagtcggattaataccctatgttttccgttgaggccatctgaagtggcataaacatttatcgctaagggatggggatgcgtctgattaggttgttggcggggtaacggcccaccaagccatcgatcagtaggggttctgagagtacgatcctcacaattggaactgagacacgggccagactcatacgggaggcagcagtgaggaatagtgggaaatggagggaactctgacacagccatgccgcgtgagtgaagaaggttttcggattgtaaagctctttcagacgggaagatgatgacggtaccgtcagaagaagcaccggctaacttcgtg

SEQ ID NO: 5105 - DNA, 371 bp, Unknown
  Ascusbbf_1343667, encodes 16S rRNA
agagtttgatcctggctcagagtgaacgctggcggcaggcctaacacatgcaagtcgaacggcagcacaggagagcttgctctctgggtggcgagtggcggacgggtgaggaatacatcggaatctgcctattcgtgggggataacgtagggaaacttacgctaataccgcatacgtcctacgggagaaagcgggggatcgcaagacctcgcgcgggtagatgcgccgatgtcagattagctggttgacggggtaatggcgcttgaaagcgacttttgttagctgagaagtcctgccgattaatactcggcggggatgacggtacccaaagaataagcaccggctaacttcgtgccagcagccgcggtaat

SEQ ID NO: 5106 - DNA, 490 bp, Unknown
  Ascusbbf_1435701, encodes 16S rRNA
agagtttgatcatggctcaggacgaacgctggcggcgtgcttaatacatgcaagtcgaacgaggtccaccctttcgcacgattggggaagacctagtggcgaacgggtgcgtaacacgtgagaaacctgccccggtctctggaataccaagtggaaacacttgctactcccgtatgccgtctgccccccgcatagtggattgacgaaagatttataggctcgggagggtctcgcggccatttagcttgttggcgaggtagcggcccaccaaggcatcgaccggtagctgttctgagaggatagtcagcccacctgggacacgaacacgacccagactcctacgtggggaagcagtagggaatcttgcacaatgggcgaaagcctgatgcagcaacgccgcgggcgggaagaaggccttagggtggtaaaccgctttcagcagggaagaaaatgacggtacctacagaagaaggtgcggccaactacgtgc

SEQ ID NO: 5107 - DNA, 486 bp, Unknown
  Ascusbbf_1435716, encodes 16S rRNA
agagtttgatcctggctcagaacgaacgctggctacaggtcttaggcatgcaagtcgaacggacgacagagtggcttttcattctgttgatagcggcgcacgagcgagtaacgcgtgggaaactgcccttcactaggctacaacgtctggcaacggacgtcaatatcgtactctctcgcctgggatacgatttaccggttatggatgtccctgggtcggtttagcttgttggtgcggtaattgcctatcatggcgatgatccacacctggtatggaaggacgatcagccactctggaacttggacacggaccagagtcgtacgggaggcagcagctaagagtattaggcaatggaggaaactctgacacagccacgccgcgggaaggaagaaggccttagagttgtaaagttctattagtgatgaagatgatgacagtagtgacagaaaaagcaccggctaacttcgtgccagcagccgcggtaat

SEQ ID NO: 5108 - DNA, 472 bp, Unknown
  Ascusbbf_1321804, encodes 16S rRNA
agagtttgatcctggctcagagcgaacgctggcggcatgcttaacacatgcaagtcgcacgaaggtttcggccttagtggcggacgggtgagtaacgcgtaggaatctatccatgggcgggggctaactctgggaaactggagctaataccgcctgatacctgagggtcaacggcgcaagtcgcctgtggaggggcgggcgttcggttagcttgtttgtggggtaatggcctaccaaggcgaggatcgataactggtctgagaggatgatcagccacactaggactgggacacggcccagactcctacggggggcaacaggggggaatattggacaatggggtcaaccctggtccagcaatgccacgggtgtgaagaaggttttcggattgtaaagcactgtcggcgggggcgatgatgacggtacccgcagaagaagcaccggctaactccgtgccagcagccgcggtaat

SEQ ID NO: 5109 - DNA, 486 bp, Unknown
  Ascusbbf_1435816, encodes 16S rRNA
agagtttgatcatggctcagaacgaacgctggcggcaggtcttaggcatgcaagtcgaacggacgacagagtggctttccattctgacgttagtggcgcacgagtgagtaacgcgtgtgaaactgtccttcactggggaataacgtctggcaacggtcgctattaccgcatacgcccgcaaggggaaagatttatcggcgacggatgcgcgcgcgttggattagcttcttggtgggttaagggcgtaccaaggggatgatccatagctggtctgagaggacgatcagctacgctggaactgagacacgggccggacagctacgggaggcagcagctacgaatattgggcaatggaggagactctaacccagccatgccgcgtgaatgaagaaggccttcgaggtagaaagttcttatagtcatgaagatgatgacagtagtgacagaaaaagcaccggctaacttcgtgccagcagccgcggtaat

SEQ ID NO: 5110 - DNA, 490 bp, Unknown
  Ascusbbf_1435822, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctacctgtcacaggggtataacggagagaaatttccactaatcccccatattgttattctttcgcatgttaggataacgaaagcttcggtggttacggatgggcatgcgtgacattagctagttggtaaggtaacggcttaccaaggcgacgatgtctaggggagctggggggcttatagcccaaacgggtaagtcgacacgaaccggacggcgacggggggcagaagggaggaagagtggtcaatggacggaagtctgaaccagccatgccgcgtggaggaagaaggtcctatgggtaggaaactcctttggttcgagagtaataagaggcttgcgagcctcgatgagagtatcggacgaataagc

SEQ ID NO: 5111 - DNA, 490 bp, Unknown
  Ascusbbf_1344004, encodes 16S rRNA
agagtttgatcctggctcaggatgaacgctggcggcgtgcctaacacatgcaagtcgaacggaaaggattcttcggaattccttcagtggcggacgggtgagtaacgcgtgggtaacctgtcccatacaggggaacaacagctggaaacggctgctaataccgcataagcgcacagtactgcatggtacagtgtgaaaagattttatcggtatgggatggacccgcgtctgataagaaagttggaggggtaacggcccaccaaggcgacgttcagtagccgacctgagagggtgaccggcgacaaagggactgggcaacggcccaaactcctacggggggcagcagtgggggatatgacacaatgggcgaaagcctgatgcagcgacgccgcgtgggggaggaagtatttcggtatgtaaagcgctatcagcagggaagaaaatgacggtacctgactaagaagccccggctaactacgtgccagcagcc

SEQ ID NO: 5112 - DNA, 486 bp, Unknown
  Ascusbbf_1372136, encodes 16S rRNA
agagtttgatcatggctcagaacgaacgctggcggcaggtcttagacatgcaagtcgaacggccgacagagtggcttgccattctgaagctagtggcgcacgagtgagtaactcgtgcgaaactacccttcactggggaataacgtcgggcaacggacgctaataccgcatacgcccgcaaggggaaatgtctatcggttatggatatgccgtcgttgcattagcgtgttgatgggaaaagttcgtaccacggcgaggatgcatacctggtctgggaggacgatcagccacgatggaactacgacagggaccagtgtggtacatgggtcagcagctaagaatatgaggcaatggagtagcgtctgacacggcggtgccgcgggaaggaagaaggctttctgcttgtaaagatcttttggtgatgcagatgatgacagtagtgaaagaaaaaggaccggctaactccgtgccagcagccgcggtaat

SEQ ID NO: 5113 - DNA, 490 bp, Unknown
  Ascusbbf_1343852, encodes 16S rRNA
agagttgatcctggctcaggatgaacgctggcggcgtgcttaacacatgcaagtcgaacggagttatctcgcttaggagggcttgctcaaatcttgatagaacttagtggcggtcgggtgagtaccgcgtggctaacctgccttatactggggtttaacacttagatataggtgctaataccgcataagcgcacgttcccgcatgggaaagtgtgatagtctccggtggtgtaagatggatgagcgtctgattagatagtgtgtgcgtaaccgccccaccaagtcaacgatcagtagccggccagagggggtgaacgaccacattgggactgcgaaacggcgcaaactcctacgggaggcagcagtggggaatagtgcacaatgggggaaaccctgatgcagcgacgccgcgtgagtgaagaagtagttcggtatgtaaagctctatcagcaaggaagaaaaaaatgacggtacttgactaagaagcacc

SEQ ID NO: 5114 - DNA, 490 bp, Unknown
  Ascusbbf_1344013, encodes 16S rRNA
agagtttgatcatggctcaggatgaacgctggcgtcgtgcctaacacatgcaagtcgaacggaaagaattcttcggaattctttcagtggcggacgggtgagtaacgcgtgggtaacctgccccatacaggggaacaacagcttgaaacggctgctaataccgcataagcgcacagtactgcatggtacagtgtgaaaagattttatcgctatgggatggacccgcggaggattagctagttggaggggtaacggcccaccaaggcgacgatcagtagccgacctgagagggtgaccggcaacattgggactgagacagggcacaaagacctacgggaggcagcggtggggggtattggacaatgggcgaaagtctgatgcagcgacgcggcgtgagtgaggaagtatttcggtatgtaaagctctatcagcagggaagaaaatgacggtacctgactaagaagccccggctaactacgtgccagcagcc

SEQ ID NO: 5115 - DNA, 342 bp, Unknown
  Ascusbbf_1372302, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgacgttagctagttggtaaggtaacgagttaaaaaggcgctttgcgctaccggatgagagtatcggacgaataagcatcggctaactccgtgccagcagccgcggtaat

SEQ ID NO: 5116 - DNA, 486 bp, Unknown
  Ascusbbf_1321963, encodes 16S rRNA
agagtttgatcctggctcagaacgaacgctggcggcaggtcttaggcatgcgagtcgaacggacgacagagtggcttgccattctgaagttagtggcgcacgagtgagtaacgcgtgggaaactgcccttcactggggaataacgtctggaaacggacgctaataccgcatacgccctcaaggggaaagatttatcggttatggttctacccgcgtgggattagcttgttggtgggggaatggcctaccaatgggatgatccctagcttgtctgtgagtacgatcagcctcgcgggaactgagacacggtccagacgcctacgggaggcagcagctaagaatattgggcaatggaggaaactctgacccagccatgccgcgtgaatgaagaaggccttcgggttgtaaagttcttttagtcatgaagatgatgacagtagtgacagaaaaagcaccggctaacttcgtgccagcagccgcggtaat

SEQ ID NO: 5117 - DNA, 490 bp, Unknown
  Ascusbbf_1372283, encodes 16S rRNA
agagtttgatcctggctcaggatgaacgctagcgacaggcctaacacatgcaagtcgaggggcagcaggggagcaatcccgctggcgaccggcgcacgggtgagtaacgcgtatgtaacctgcccatgagtgggggatagcccagcgaaagctggattaataccgcatgaaaccgtttgaagacatctgataatggttaaagatttattgctcatggatggacatgcgtccgattagctagttggcggggcaacggcccaccaaggcgacgatcggtaggggttctgagaggaaggtcccccaaagtgggagcgggaaaacgaacaaactgcgaagggggggaggaaggaagaaagatgggacaatgggaggaagcagaacccagccaagtccggagaaggatgagggtattatgttgtgaaaacttctttagcggtggagtaataggggggtggagacaacgaaggcaagaacactagaaataggggtc

SEQ ID NO: 5118 - DNA, 490 bp, Unknown
  Ascusbbf_1321956, encodes 16S rRNA
agagtttgatcctggctcaggatgaacgctagcggcaggcttaacacatgcaagtcgaggggcagcgcggggtagcactactctggcggcgaccggcggaagggtgcgtaacgcgtgagcaacatgcccgtggcagggggataagcgatggcaacgtcgtctaagaccccgtcacaacagacctcgcatggggtttgtttgaaagcttcggcggccacggatttgctcgcgtcccattaggcagtgggcggggtaacggcccaccaaaccgacgatgggtaggggttcggagaggaaggtaccgtacagtggaactgaggcaccgtccagaatcggacggcaggcagcggggaggaagattggtcgatgggcggaagcctgaaccagccatgcagcgtgcaggaataaggcccgacgggtcgtaaactgcttttggacgggagcaataagggtcaagagtggcctgatgagggtaccgtacgaataagca

SEQ ID NO: 5119 - DNA, 490 bp, Unknown
  Ascusbbf_1344054, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccagattgttattctttcgcatgttaggataacgaaagcttcggttgttacggaagggcatgcgtgacaatagctagttggtaaggtaacggcttaccaaggagacgatgtctaggggagctgagaggcttatcctccacactggtactgagaaccgaaacagactccgacgggaggcagaagcgcggaatattggcaactggacggaagactgaacaagcgaggccgcgtggaggaggaaggtccgaggggttgtaaactgcttttgttcgagagtaataagggctttgcgaagcacgatgagagtatcggacgaataagc

SEQ ID NO: 5120 - DNA, 490 bp, Unknown
  Ascusbbf_1435669, encodes 16S rRNA
agagtttgtcatggctcaggatgaacgctagctacaggcttaacacatgtaagtcgagggggagaagaacgaaagggggcggggggggcgggagaacggggcacgggtgagtaacgcgtatccaaccttccccttagtagggcatagcccggcgaaagtcggattaataccctatgttttccgttgaggacatctgaagtggaacaaagatttatcgctaagggatggggatgcgtctgattaggtggttggcggggtaacggcccaccaagccatcgatcagtaggggttctgagaggaaggtcccccacataggtcctgagacacggcccaaactcctacggggggcagcagtgaggaatattggtcaatgggcgagagcctgaaccagccaagtagcgtgcaggatgacggccctatgggttgtaaactgcttttgcatgggaataaagtgagggacgtgtccctttttgtatgtaccatgagaata

SEQ ID NO: 5121 - DNA, 490 bp, Unknown
  Ascusbbf_1341639, encodes 16S rRNA
agagtttgatcctggctcaggacgaacgctggcagcatgcttaacacatgcaagtcgaacggactgattccttcgggttgacctttcgtggcgaacgggtgagtaatgtatgatcaacctgcctctgtcaacgtgctaacagttggaaacgcctgctaatacggtatacgaccacggcaccgcatggtgctgcggtaaacgatgtttcggacagagatgggctcatatcccattagctggttgggaagataatagcccaccaaggcgacgctgggtagccgagttgagaggctgatcggccacatagggactgacagacggcccagagtcctacgggaggcagcagtggggaagagtgggcaatggaggaaactctgacaaagcaatgccgcgtgagcgatgaaggtaagtttattgtaaagctcgtttctaaggaacgaataaagatgacggtaccggaggaataagccccggctaactacgtgccagc

SEQ ID NO: 5122 - DNA, 490 bp, Unknown
  Ascusbbf_1341642, encodes 16S rRNA
agagtttgatcctggctcaggacgaacgctggcagcatgcttaacacatgcaagtcgaacggactgattccttcgggttgacagttagtggcgaacgggtgagtaatgtatgagcaacctgcctctgtcaacgtgataacagttggaaacgactgctaatacggtataagaccacggccccgcatggtgctgcggtaaaagctttttcggacagagatgggctcatatcacattagctcgtgggtgggataatggcccaccaaggcgacggtgggtagccgcgttgagaggctgatcggcaacaatgggactgaaacacggcccagactcctacgggaggcagcaggggggaatagtgggcaatggaggaaagtctgacaaagcaatgccgcgtgagcgatgaaggtaagtttatgggaaagctcgtttcgaaggaacgaataaagatgacggtaccggaggaataagccccggctaactacgtgccagc

SEQ ID NO: 5123 - DNA, 490 bp, Unknown
  Ascusbbf_1341630, encodes 16S rRNA
agagtttgatcctggctcaggatgaacgctggcggcgtgcttaacacatgcaagtcgaacggagttatctcgctgaggagagcttgctcaaatcttgagataacttagtggcggacgggtgagtaacgcgtggataacctgccttataccgggggataacacttagaaataggtgctaataccgcataagcgcacgatcccgcatgggaaagtgtgaacaactccggtggtataagatggatccgcgtttgattagatagttggggaggtaagggcccaccaagtcaacgatcagtagccgacataagtgggagagcgacaacattgggactgagacacggcccaaaagcctacgggagggagaagtggggaagattgcgaaatgggggaaaacctgatgcagcgacgccgcgtgagggaagaagtatttcggtatgtaaagctctatcagcaaggaagaaaaaaatgacggtacttgactaagaagccc

SEQ ID NO: 5124 - DNA, 490 bp, Unknown
  Ascusbbf_1371799, encodes 16S rRNA
agagtttgatcatggctcaggatgaacgctagcggcaggcttaacacatgcaagtcgaggggtaacgcggggtagcactactctggcgacgaccggggcacgggtgcgtaacgcgtatgcaacctacctgtaacaggggtataacggagagaaatttccactaatcccccatatcgttattctttcgcatgttaggataacgaaagcttcggttgttacggatgggcatgcgtgacattagctagttggtaaggtaacggcttaccaaggcgacgatgtctaggggagctgagaggcttatcccacaaacgggtacggagacacggaccagaatcctacggggggcagcagtgaggaatagtggacaatggacggaagtgtgaaccagccatgcagcgtggaggaagaaggtcctatgggtggtaaactccttttgttcgagagtaagaagaggagtgcgagcaccgatgagagtatcggacgaataagc

SEQ ID NO: 5125 - DNA, 490 bp, Unknown
  Ascusbbf_1341641, encodes 16S rRNA
agatttgatcatggctcaggatgaacgctagctacaggcttaacacatgcaagtcgaggggaaacgatattgaaagcttgctttcgataggcgtcgaccggcgcacgggtgagtaactcgtatccaacctgcctggaaatagggactaatccgtggaaacgcggcctaatgtcctatgtgctccgaagaggacatctgatttggagtaaagattcatcgtttccggatggggatgcgtctgattagcttgctggcggggtaacggcccaccagggcgacgatcagtaggggttctgcgaggaaggccccgagcagtggaactgagagacggtccaaaagcctacgggaggcagcagtgaggaagattggtcaatggacgagagtctgaaccagccaaggagcgtgaaggaggacggccctatgggttgtaaactgcttttatgcggggataaagtgcgcaacgtgtggtgtattgcaggtaccgcaagaa

SEQ ID NO: 5126 - DNA, 490 bp, Unknown
  Ascusbbf_1436139, encodes 16S rRNA
agagtttgatcatggctcaggatgaacgctagcggcaggcttaatacatgcaagtcgaggggtaacgcggggtagcaatactctggcgacgcccggcccccgggtgcgtaacgcgtttgcaacctccctgtaacaggggtataacggagagaaatttccactaatcccccatattttttttctttcccatgttaggataacaaaagctccgttgtttacggatggccaggcgtcacattagtgatttgttaaggtaacgccttaccaaggcgaggttggcatggggagctgagaggcttatcccccacactggtacggagacacggaccagactcctacgggaggcagcagtgaggaatattggtcaatggacggaagtctgaaccagccatgccgcgtggaggaagaaggtcctatgggttgtaaactccttttgttcgagagtaataagaggcttgcgagcctcgatgagagtatcggacgaataagc

SEQ ID NO: 5127 - DNA, 490 bp, Unknown
  Ascusbbf_1371453, encodes 16S rRNA
agagtttgatcatggctcaggatgaacgctagctacaggcttaacacatgcaagtcgaggggcagcagatcgaaagcttgcttttgatgctggcgaccggcgcacgggtgagtaacgcgtatccaaccttccctatagtagaggatagcccggcgaaagtcggattaatactctatgttgtatttcgaggacatctgaagaataccaaaggtttaccgctataggatggggatgcgtctgattaggttgttggcggggtaacggcccaccaagcccacgatcagtaggggttctgagaggaacggcgccaagatcgagactgcgacggggcgcagacgcctacgagaggcagcagtcgggagtattgcgaaatggaggaaaagcggacggagtgacgccgcgtgcaggaggaaggtgctcggattgtaagctgcagtagagagggaagaaaaaaatgacggtacctattgaataagcaccggctaactac

SEQ ID NO: 5128 - DNA, 490 bp, Unknown
  Ascusbbf_1436175, encodes 16S rRNA
agagtttgatcctggctcaggatgaacgctagctgcaggcttaacacatgcaagtcgaggggcaacgtggggtagccatactctggcgacgaccggcccacgggtgcgtaacgcgtatgcaacctacctttcacaggggtataacggagcgaaatttccactaatcccccctctttttattctttcgcatgcaaggataacgaaagcttcggtggttacggatgggcatgcgtgactttagttagttggtaggttaacggcataccaaggcgacgatgtctaggggagcttagaggcttatcccccacactggaactgagacacggaccagactcctacgggaggcagcagtgaggaatattggtcaatggacggaagtctgaaccagccatgccgcgtggaggaagaaggtcctatgggttgtaaactgcttttgttcgggagtaataagagctatgcgaagcccgatgtgggtatcggacgaataagc

SEQ ID NO: 5129 - DNA, 490 bp, Unknown
  Ascusbbf_1341565, encodes 16S rRNA
agagtttgatcctggctcagagcgaacgctagcggaatgctttatacatgcaagtcgaacggattttgatttttgtagcaatacaaagattacgattagtggcgaacgggtgagtaatagttaggaacttgccgaatagtgggggacaacagttagaaatgactgctattaccgcatactcccgagaggggaaagatttattgcgattcgagaggccgaaccacgattagcttgttggcggtgtaattgccaaccaaggcagtgatcgttagccgatcttagaggatgatctgccacattgagactgagacgcggcacaaactcctaagggaggcagcagtagggaatattggacaatggacgcaggtctgatccagcaattccgcgggggtgaagaaggtgttatgcagtgtaaaactctttggcccatgaagacaatgacggtagtgtgagaataagcaccgactaactatgtgccagcagccgcggt

SEQ ID NO: 5130 - DNA, 484 bp, Unknown
  Ascusbbf_1436211, encodes 16S rRNA
agagtttgatcatggctcaggatgaacgctggcggcgtgcttaacacatgcaagtcgaacggagaaccgcccttcgggtcggttcttattggcgtacgggtgagtaacacttgggaacataccttatagtgggggataactattggatacgcttgataataccgcattagtcctaagggagaatggtgtaattcgccataagattgtcccgcggtagtttaggcagttggtggggtcaacgccttcataacctacgatcgttacctggtctgagaggactatcagccacattgggaccgagacacggctcaaagagcaacggtgggcagcagtgaggaatattaggcaatgggggcaaccctgactcagccatgccgcgtgagtgaagaaggttttcgaattgtaaagctctttcggatgtgaagattatgacggtagcatctaaagaagccccggcaaactccgtgccagcagccgcggtaat

SEQ ID NO: 5131 - DNA, 490 bp, Unknown
  Ascusbbf_1436214, encodes 16S rRNA
agagtttgatcatggctcagaatgaacgctggcggcatggattaggcatgcaagtcgaacgggtcccttcggggactagtggcgcaagggtgagtaacacgtgatcaacctgcccccgaatccggaataatccagggaaacttggtctaaaaccggatgtcggcgtttacccgcatgggtttccgccgaaatattcatagttcggggatgggctcgcgtcccattagctggttggctgggtaactgcccaccaaggctacgacgggtaggtgtgctgtgaggatggtcacccacactgggactgggacactgcgcagacgcctacgcgagggtgaagtggagagtatacagcaaagggcgcaagcctgacggagcgatgccgcgtgaggaaagagggccttcgggttgtaaacctctgtcacccgggacgaaatcaatgacggtaccgggaaaggaagccacggctaaccacgtgccagcagccgcggta

SEQ ID NO: 5132 - DNA, 490 bp, Unknown
  Ascusbbf_1371801, encodes 16S rRNA
agagtttgatcctggctcaggatgaacgctagcggcaggcttaacacatgcaagtcgaggggtaacgcggtgtatcattactctggctactaccggcgcacgggtgcgtaactcgtatgcaacctacctttaccatggttataacggagagaaatttccactaatcccccctcttttttgttatttgcatgtttctctattgaaagcttcgtttgttactgttgggcatgcgtgcctttggatagttggtaaggtaacggcttaccaaggcgacgttgtctaggggggcgtagaggcttttccccaacactggtacggagacacggtccaaactcctacgggaggcagcagtgaggaatattgggcaatggacggaagtctgaaccagccatgcagcgtggaggaagaaggtcctatgggttgtaaactccttttgtgcgagagtaataagaggcatgcgagccgagatgagggtatcggacgaataagc

SEQ ID NO: 5133 - DNA, 490 bp, Unknown
  Ascusbbf_1341600, encodes 16S rRNA
agagtttgatcctggctcaggatgaacgctagctacaggcttaacacatgcaagtcgcggggcatcgcgaagggtatcaatactctttggcggcgaccggcggatgggtgagtaccgcgtatccaccctgtccctgtctcgggcacagcccctcgaaagagggattcattcccgatttccccgtcagttcgcatgttcttccgggcacatgtcttcatctgatcgggatggggatgcgttccattaggcggtcgccggggtaacggcccaccgagcctacgatggataggggatcggacaggaaggcacacggcaatgggactgagaaccggcccggactcgtacgggagggagcagtgaggaatattggtcgatggcggcaacgctgaaccagccaagtagcgtgagggattacggccctatgggtcttaaacctcttttgttggggagcaacctgtgcaacttgtggcacactgcgagtacccttcga

SEQ ID NO: 5134 - DNA, 490 bp, Unknown
  Ascusbbf_1436115, encodes 16S rRNA
agagtttgatcatggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacggtgtgtaatactcgataacatttggattcacatggctttatattgaaagattcgttgttgacggatggactcgcgttacattagctagtcggctgggtaccggcccacctcgcctacgatgtttaggggttctgggaggaagctacaccacatggaaactgagaaacggtcaagactagtacgggaggcagcagtgaggaatattggtcgaggggcggaagcctgaaccagccaagccgcgtgcaggaagaaggccctatgggtcgtaaactgcttttccatgagggcaataagggtcacgtgtggtccgatgagagtatcagatgaataagca

SEQ ID NO: 5135 - DNA, 490 bp, Unknown
  Ascusbbf_1341617, encodes 16S rRNA
agagtttgatcctggctcaggatgaacgctagcggcaggcttaacacatgcaagtcgaggggcagcgcggggtagcaatactctggcggcgaccggcggacgggtgcgtaacgcgtgagcaacttgcccgtcactgggggataggcactggaaacggtgtgtaatactccataacatatggattcacatggattcatattgaaatattcgtcggtgacggatgggctcgcgtaacattagctagtcggcggggtaacggcccaccggggctacgatgtttaggggttctgagaggaaggtccccgcaattgaagctcagacagggtccagactccgacgggaggcagaagtgaggaagattggtcaatgggcggaagcctgaaccagccaggcggcgtgcaggaataaggccctatgggtcgtaaactgcttttcctggagggcaataagggcacgagtggcccgatgagagtatcaggggaataagcac

SEQ ID NO: 5136 - DNA, 490 bp, Unknown
  Ascusbbf_1436144, encodes 16S rRNA
agagtttgatcatggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacggtgtgtaatactccataacatatggattcacatggattcatattgaaagattcgttggtgacggatgggctcgcgtaacattagctagtcggcggggtaacggcccaccgaggctacgatgtttaggggttctgagaggaaggtcccccacactggaaacgagaaacggtcccgaatcccacgggaggcaggcgtgaggaaacatggtcaatgggcggaagcctgaacccaccatgccgcggtcaggaataaggccctatgggtcgtaaactgcttttccttgagggcaataagggtcacgtggggtccgatgagagtatcaggggaataagca

SEQ ID NO: 5137 - DNA, 490 bp, Unknown
  Ascusbbf_1371763, encodes 16S rRNA
agagtttgatcctggctcaggatgaacgctagcgacaggcttaacacatgcaagtcgaggggcaacgcggggttagaatactctcgcgacgaccggcgcacgcttgcgtgacgcacatgtaacctacctgtaacagtggtataacgaacacgaatatacactaatcccccctattgtttgagattcgcatgtttctctaacgtaacctacgttggccagtgatgggcatgcgtgacattagctagttggtaagggaacgccttaccaagccgacgatgtctaggggggctgagaggctggtcccccacactggtactgagacacggaccagactcctacgggaggcagcagtgaggaatattggtcaatgggcggaagcctgaaccagccaagccgcgtggaggaagacggccctatgggttgtaaactgcttttgtccgggagtaataagaggcacgcgagcctcgatgagagtaccggacgaataagc

SEQ ID NO: 5138 - DNA, 485 bp, Unknown
  Ascusbbf_1341614, encodes 16S rRNA
agagtttgatcctggctcagaacgaacgctggcggcaggtcttaggcatgcaagtcgaacggacgacagagtggcttgccattctgaagttagtggcgcacgagtgagtaacgcgtgggaaactgcccttcactggggaataacgtctggacacggacgctaataccgcatacgcccgcaaggggaaagatttatcggtgatggatgtgcccgcgttggattagcttgttggtggggtaatggcctaccaaggcgatgatccatagctggtctgagaggacgatcagccacgctggaacacggacacgggcaggacgcatacgtgaggaagcagctaagaatagagggcaatgaggggagctctgaacgagccatgcagggggaatgaagaaggcctacaggttgtaaagttcatggagtcatgaagatgatgacagacgggacggaaaaagaacgggctaacatggtgcaagaggccgcgtaat

SEQ ID NO: 5139 - DNA, 490 bp, Unknown
  Ascusbbf_1436136, encodes 16S rRNA
agagtttgattatggctcaggatgaacgctagctacaggcttaacacatgcaagtcgaggggcagcatgtagctggcttgccagatatgatggcgaccggcgcacgggtgcgtaacgcgtatccaacctgccgtttacccggggacagcctcgcgaaagcgagattaatacccgatgttgtgcgtagtccgcatggggtgcgcaccaaaggattttccggtaagcgatggggacgcgtacgattagctggtcggcggggtaacggcccaccgaggcatcgatcgttaggggttctgagaggatggccccaccacctgggactgagccacggcccagacgcctacgggaggcagcagtgacgaatattcgtcaatgggcgtaagcctgaaccagccaagtagcgtgcaggacgactgccttacaggttgtaaactgcttttatgcgggggtaaagtgtcccacgtgtgggatattgcacgtaccgcatgaa

SEQ ID NO: 5140 - DNA, 490 bp, Unknown
  Ascusbbf_1341635, encodes 16S rRNA
agagtttgatcatggctcaggatgaacgctagtggcaggcttaacacatgcaagtcgaggggtaacgcgggggagcaatactctggcgacgaccggcgcacgggggcgtaacgcgtatgcaaccgacctgtaacagggggagaacggagagaaatgtccactaatcccccatatttttattctttcgcatgttaggataacgaaagcttcggtggtgacggatgggcatgcgtgacattagctagttggtaaggtaacggcttaccaaggcgacgatgtctaggggagctgagaggcttatccgcacacatgggacggggttccggcccagaatcctacgcaaggaagccgtgcggaatattcggcaatggacggaagtctgaaccagccatgcagcgtggaggaagaaggtcctatgggttgtaacctccttttgttcgagagtcataagggctttgcgaagaccgatgagcgtatcggacgaataagc

SEQ ID NO: 5141 - DNA, 490 bp, Unknown
  Ascusbbf_1341629, encodes 16S rRNA
agagtttgatcatggctcaggatgaacgctagcggcaggcttaacacatgcaagtcgaggggtaacgcggggtagccttactctgtctactaccggcccacgggtgcgtaacgcgcatgcaacctacctgtaccagggttataacggagagaaatttccactaatcccccctattttttttctttcgcatgtttggataacgaaagcttcgtttgttacggatgggcatgcgtgccattagctagttggtaagctaacggcctaccaaggcgacgatgtctaggggagctgagaggcttatcccccacactggaactgcgacacggaccaaactcctacgggaggcagcagtgaggaatattggtcaatggacggaagtctgaaccagccatgcagcgtggaggaagaaggtcctatgggttgtaaactccttttgtacgggagtaataagaggcatgcgagccgcgatgagagtatcggacgaataagc

SEQ ID NO: 5142 - DNA, 468 bp, Unknown
  Ascusbbf_1341653, encodes 16S rRNA
agagtttgatcctggctcagagcgaacgctggcggcaggcttaacacatgcaagtcgagcgccccgcaaggggagcggcagacgggtgagtaacgcgtgggaagctacccagcgctacggaataactcagggaaacgggtgcgaataccgtatacgcccttcgggggaaagatttaccggagatggatgagcccgcgtgggatgagctaggtggtgaggtaaaggctcaccaaggcgacgatccatagctggtctgagaggatgatcagccacactgggacggagacacggcccagactcctacgcgcggcagccgtggggaatcttggcccctgggcgccagcctgctcctgccctgccgcgtgagtgatgacggccctagggttgtaaagctctttcaccggtgaagataatgacggtacccggagaagaagccccggctaacttcgtgccagcagccgcggtaat

SEQ ID NO: 5143 - DNA, 375 bp, Unknown
  Ascusbbf_1341654, encodes 16S rRNA
agagtttgatcatggctcaggatgaacgctagctacaggcttaacacatgcaagtcgaggggcagcgagaggaaagcttgctgtccttgtcggcgaccggcgcacgggtgagtaacgcgtatccaaccttccccttagtagggcatagcccggcgaaagtcggattaacaccctatgttatcagaagaggacatctggcttggattaaagatttagcgctatgggatggggatgcgtctgattaggtagtaggcggggtaacggcccaccgggtcgtagaccagtaggggttctgagaggagtgggggacttgtcccttttggtaggtaccgtatgaataaggaccggctaattccgtgccagcagccgcggtat

SEQ ID NO: 5144 - DNA, 490 bp, Unknown
  Ascusbbf_1341634, encodes 16S rRNA
agagtttgatcatggctcaggatgaacgctagtggcaggcttaacacatgcaagtcgaggggtaacgcggggtagcaatactctggcgacgaccggcgcacgggggcgtaacgcgtatgcaaccgacctgtaacagggggagaacggagagaaagttccactaatcccccatattgttattctttcgcatgtgaggataacgaaagcttcggtggttacggatgtgcaggcgtgacattagctagttggtaaggtaacggcttaccaaggcgacgatgtctaggggagctgagaggcttatccccaacactgtgactgggttacggcccagactcctacgggaggcagccgtgaggaatattggtcaatggacggaagtctgaaccagccatgccgcgtggaggaagaaggtcctatgggttgtaacctccttttgttcgagagtaataagggctgtgcgaagcccgatgagcgtatcggacgaataagc

SEQ ID NO: 5145 - DNA, 468 bp, Unknown
  Ascusbbf_1341643, encodes 16S rRNA
agagtttgatcctggctcagagcgaacgctggcggcaggcttaacacatgcaagtcgagcgccccgcaaggggagcggcagacgggtgagtaacgcgtgggaatctaccaatctctacggaataacgcagggaaacgggtgctaataccgtatacgccctgcgggggaaagatttatcggagatggatgagcacgctttggatgagctagttggtgaggtaaaggctcaccaaggcgacgatccatagctgggcggagaggatgagcagcccccctgggactgagacacggcccagactcctacgggcggccgccgtggggactcttggccactcggcgcacgcctgttcccgccctgccgcgtgcgtgatgacggccctagggttgtaaagctctttcaccggtgacgataatgacggtacccggagaagacgccccggctaacttcgtgccagcagccgcggtaat

SEQ ID NO: 5146 - DNA, 490 bp, Unknown
  Ascusbbf_1371616, encodes 16S rRNA
agagtttgatcctggctcaggatgaacgctagctacaggcttaacacatgcaagtcgaggggcaacgagagcttaagtttctaatagttctgggaacccgcgcgcatgggtgtgacacgtgtaccaccttcgccgtaatgtagcgtaccgcgttgcgaatgtaagttttatgctctatgtgctgtgatgaggatatgtgcattgcagaaaagttttagcgctttgcgatggggatgtgcgtgattaggttgttggcggggtaagggcctaccaagcccgcgttcagtagggggtctgaggggaaggtcctccacattggaactgcgacacggtccaaactcctacgggaggcagcagtgaggaatattggtcaatgggcgagagcctgaaccagccaagtagcgtgcaggacgaaggccctgtgggttgtaaaccgcttttacggggggataaagtgagagacgtgtcgttcattgcaggtaccgcacga

SEQ ID NO: 5147 - DNA, 490 bp, Unknown
  Ascusbbf_1371595, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgacattagctagttggtaaggtaacggcttaccaaggcgacgatgtctaggggagctgaaaggcgtatccccaacactggaactgggaaacggaccaaactactgcgggagggagcagtgaggaatattggtcagtggacgggagtctgaaccagccaagccgcgtgggggaagaaggtcctatgggttgtaaactgcttttgtgcgagagtaataagggctttgcgaagcccgatgagagtatcggacgaataagc

SEQ ID NO: 5148 - DNA, 490 bp, Unknown
  Ascusbbf_1371611, encodes 16S rRNA
agagtttgatcctggctcaggataaacgctggcggcgcacataagacatgcaagtcgaacggacttaactcattcttaacgattgagagcggttagtggcggactggtgagtaatgtataagtaacctgcctttcagaggggaacaacagttggaaacgactgctaataccgcatattccacgagaatcacatgattcaagtgggaaaggagcaatccgctgatagatggacttatatctgattagcgagctggtggggtaacggcctaccaaggcgacgatcagtagccggactgagcggttgagcggcaccgttggggctgagctacggcccagactccgacgggaggcagcaggcgggaatgttgagcaatggagggcacgctgacgcagtgacgccgcgggcaggaagaaggttttcggattgtaaactgctttagacagggaagaaaaaagacagtacctgtagaataagctccggctaactacg

SEQ ID NO: 5149 - DNA, 490 bp, Unknown
  Ascusbbf_1371614, encodes 16S rRNA
agagtttgatcatggctcaggatgaacgctagcgacaggcctaacacatgcaagtcgaggggcagcgcgggagaagcttgcttttcctggcggcgaccggcgcacgggtgcgtaacaggtgtgcaatctgtccatagtcggggaatagcccagcgaaagttggattaatgctccatgtgtcacgaagccgcatgactttgtgatgaaacgtaaggactatgggtgagcacgcttctgattagatagttggtgaggtaacggctcaccaagtcgacgatcagtaggggttctgagaggaaggtgccacgatgacggaatgagtaacgatgcaaagacctacgggaaggcgcagggagcaagagtggacaaggggcgagagcctgaaccagccaagtcgcgtgaaggaagaagggtctcgggagtgtaaactgcttttgtccgggagtaagaaaggccacgtgtcgcttcttgcaagtatcggacgaataag

SEQ ID NO: 5150 - DNA, 490 bp, Unknown
  Ascusbbf_1341205, encodes 16S rRNA
agagtttgatcatggctcaggatgaacgctggcggcgtgcttaacacatgcaagtcgaacggagttatctcgctgaggatagcttgctcaaatcttgagataacttagtggcggacgggtgagtaacgcgtggataacctgccttataccgggggataacacttagaaataggtgctaataccgcataagcgcacgatcccgcatgggaaagtgtgcaaaactccggtggtataagatggatccgcgtctgattagatagttggtgaggtaacgccccaccaagtcaacgatcagtagccggcatgagagggcgaactgcgacattgggactgagaaacggcacaaaatcctacgggaggaagcaggggggaatagtgcaaaatgggggaaaccctgatgcagcgacgccgcgtgagtgaagaagtatttcggtatgtaaagctctatcagcaaggaagaaaaaaatgacggtacttgactaagaagcac

SEQ ID NO: 5151 - DNA, 490 bp, Unknown
  Ascusbbf_1321741, encodes 16S rRNA
agagtttgatcctggctcaggatgaacgctggcggcgtgcttaacacatgcaagtcgaacggagttatctcgctgaggagagcttgctcaaatcttgagataacttagtggcggacgggtgagtaacgcgtggataacctgccttataccgggggataacactagaaataggtgctaataccgcataagcgcatcatcccgcatgggaaagtgtgaaacaccccggtggtcttagatggaatcgcgtcagcttaggtagttgggggggcaaaggcccaccaggtcaacgattagtagccggcctgagaggctgaacggccacattgggactgagacacggcccaaacgcctacgggaggcggcagtggggaatattgcacaatgggggaaacccggatgcagcgacgccgcgtgagtgaagaagtatttcggtatgtaaagctctatcagcaaggaagaaaaaaatgacggtacttgactaagaagcccc

SEQ ID NO: 5152 - DNA, 485 bp, Unknown
  Ascusbbf_1371566, encodes 16S rRNA
agagtttgatcatggctcagaacgaacgctggcggcaggtcttaggcatgcaagtcgaacggacgacagagtggcttgccattctgaagttagtggcgcacgagtgagtaacgcgtgggaaactgcccttcactggggaataacgtctggaaacggacgctaataccgcatacgcccgccaggggaaagatttatcggtgatggatgttcccgcgttggattaccttgttggtggggtaatggcctaccaaggcgatgatccatagctggtctgagaggacgatcagccacgctggaactgaggaacggtccagagtcagacgggaggcagcagctaagagtatggggcaatggaggaaactctcaccaagccatgccgcgtgaatgaagaaggccttcggggtgtaaagttcttttagtcaggaagatgatgacagtagtgacagaaaaagcaccggctaacgtcgtgccagcagccgcgtaat

SEQ ID NO: 5153 - DNA, 490 bp, Unknown
  Ascusbbf_1436572, encodes 16S rRNA
agagtttgatcctggctcaggatgaacgctagctacaggcttaacacatgcaagtcgaggggcagcataacgaaagcttgctgttgttgatggcgaccggcgcacgggtgagtaacgcgtatccaaccttccccttagtagggcatagcccggcgaaagtcggattaataccctatgttttccgttgatgacatctgaagtggcataaagatttatcgctaatggatgtggatgcgtctgattaggttgttggctgggtaacggcccaccaaaccatcgatcagtaggggttctgagaggaaggttccctcgaatggtactgagacacggaccaaactcctacgggaggcagcagtgaggaatattagtcgatgagcgagagcctgaaccagccaagtagcgtacaggatgacggccctatggggtgtaaactgcttttgcatgggaataaagtgagggacgtgtcccttcttgtatgtaccatgagaat

SEQ ID NO: 5154 - DNA, 490 bp, Unknown
  Ascusbbf_1341386, encodes 16S rRNA
agagtttgatcctggctcaggataaacgctggcggcgcacataagacatgcaagtcgaacggacttaactcattcttcacgcttgatagcggttagtggcggactggtgagtaatgtataagtaacctgcctatcagatgggaacaacagtttgaaccgactgctaataccgcatatgccacgagaatcacatggttcaagtgggaaaggagcaatccgctgttagatgtacttatatcttattcgctagtttgtggggtaacggcctaccaaggcgacgatcagtagccggactgagagggtaaacggccacattgggactgcgatacggcccagactccgacgggaggaagcagtcgggaagattgcgcaatggaggaaactctgacgcagtgacgccgcgtgcaggaagaaggttttcggattgtaaactgctttagaaagggaagaaaaaagacagtacctgtagaataagctccggctaactacg

SEQ ID NO: 5155 - DNA, 490 bp, Unknown
  Ascusbbf_1341371, encodes 16S rRNA
agagtttgatcatggctcaggataaacgctggcggcgcacataagacatgcaagtcgaacggacttaactcattcttaccgattgagagcggttagtagcggactggtgagtaatgtataagtaacctgcctatcagaggggaacaacagttggaaacgactgctaatcccgcatattccatgagaatcacttggttcaattgggaagggagcattccgctggtgtatgaccttttatcagattatctagttggtggggtaacggcctacaaaggatccgatcagtggccggacggaggggttaaccggccaaagtgggactgagatacggcccagactcctacgggaggaagcagtcgggaatattgcgcaatggaggaaactctgacgcagtgacgccgcgtgcaggaagaaggttttcggattgtaaactgctttagacagggaagaaaaaagacagtacctgtagaataagctccggctaactacg

SEQ ID NO: 5156 - DNA, 490 bp, Unknown
  Ascusbbf_1321721, encodes 16S rRNA
agagtttgatcctggctcaggatgaacgctagcggcaggcttaacacatgcaagtcgaggggcagcgcggggtatcactactcttgctgctaccggcggacgggtgcgtaactcgtgcgcaacttgcccgtcactgggtgataggcactggcaacggtgtgtaatactccatcacatttggattcacatggctttatatttaaagattcgttgtttacggattggctcgcgtaacattatctagtcggcggtgtaccggcccaccgaggccacgatgtttagtggttctgagaggaaggtccccaaaacgggaactgggaaacggtccagaagcctacgggaggcagcagtgaggaatagtggtcaatgggcggaagcctgaaccagccatgcagcgtgaaggaataaggccctatgggtcgtaaactgcttttccttgagggcaataaggggcacgtgtggcccgatgagagtatcaggggaataagca

SEQ ID NO: 5157 - DNA, 488 bp, Unknown
  Ascusbbf_1436547, encodes 16S rRNA
agagtttgatcatggctcagaacgaacgctggcggcaggcttaacacatgcaagtcgagcgggaattggagatagcttgctatcgaagaggagagcagcgcactggtgagtaacacgtgggaacataccttttggtgggggacaacagttggaaacgcctgctcataccgcataagccctgagggggaaagctttattgccgagtgattggtccgcggaagattaggtagttggtggggtaactgcctacctagccaacgatctatagctggtctgtgaggacgataagccaccttgggcgtgagacaccggcccgactcatacgggggggaagggggggggagattgggcaaggggggcaacgctggcccagccaagccgcgggagagaagaaggttttcggattgtaaagctctttcggacgtgaagatgatgacggtagcgtctaaagaagccccggctaacttcgtgccagcagccgcggtaat

SEQ ID NO: 5158 - DNA, 490 bp, Unknown
  Ascusbbf_1321713, encodes 16S rRNA
agagtttgatcatggctcaggacgaacgctggcggcatgcttaacacatgcaagtcgaacggactgattccttcgggatgaaagttagtggcgaacgggtgaggaatgtatgagcaacctgcctctgtcaacgggataacagttggaaacgactgctaatacggtataagaccacggcaccgcatggtgctgcggtaaaagatttttcggacagagatgggcgcatatcccattagctagttggtgagataatagcccaccaaggcgacgaggggtagccgagctgaaaggcttatcggccacagtggaactgccacacggacgcgacacctacgagaggaagcagtggggagagtggggcaatggaggaagctctgagccagaaataccgcgtgagcgatgaaggtaattttattgtaaagatcttttctcaggaacgaataaagatgacggtacctgaggaataagcaccggctaactacgtgccagc

SEQ ID NO: 5159 - DNA, 490 bp, Unknown
  Ascusbbf_1341385, encodes 16S rRNA
agagtttgatcctggctcaggataaacgctggcggcgcacataagacatgcaagtcgaacggtctcacctcattcttaacgattgagtgcggttagtgcccgactgcggagtactgtttcagtcaccttcttatcagaggggaacaacagttggaaacgactgctcatacctcttattccacgttcatctcattgttcaactgggaaaggagcaatcagctgatagctggccttacatcggattagttatttggtggggtcacggccgaccaaggcgacgatcagtagccggactgcgtggttaagaggcgacatagggactgagatacggccccgacgccgacgggaggcagcagtagggaagattgagcaatggaggaaactctgacgcagtgaggccgcgggcaggaagaaggttttcggattgtaaacagattgagaaagggaagaaaaaagacagtaccggtagaataagctccggctaactacg

SEQ ID NO: 5160 - DNA, 490 bp, Unknown
  Ascusbbf_1436477, encodes 16S rRNA
agagtttgatcatggctcaggataaacgctggcggcgcacataagacatgcaagtcgaacggacttaactcattcttaacgattgagagcggttagtggcggcctggtgagtaatgtataagtaacctgcctctcagaggggaccaacagttggaaacgactgctaataccgcatatgccacgagaatcacatggttcacgtgggaaaggggcaatccgctgatagatggacttatagctgattagctagttggtggggtaacgccctaccaacgcgacgatcagtagccggactgagaggttaaacggcgacatagagactgagagacggcacagactccgacgagaggcagcaggcgggaagattgcgcaatggaggaaactctgacgcagtgacgccgcgggcaggaagaaggttttcggattgtaaactgctttagacagggaagaaaaaagacagtacctgtagaataagctccggctaactacg

SEQ ID NO: 5161 - DNA, 490 bp, Unknown
  Ascusbbf_1371413, encodes 16S rRNA
agagtttgatcctggctcaggacgaacgctggcggcgcgcttaacacatgcaagtcgaacggtgaacagcggaaagcttgcttttagctgttcatagtggcgtacgggtgagtaacgcgtgaggacttgtcctgtacagggggacaactgatggaaacgtcagctaataccccacgagccgcgaggaaaaaggagcgatccggtacatgagagtctcgcgttctagcggttagttggtgaggtaacggcccaccaaggcgaatgcggagagccggactgagaggttggccggccacattggaactgagagacggtccagactcctgcgggaggcagcagtggggaatattgggcaatgggggaaagcctgacccagcgacgccgcgtgagtgaagaaatccctcgggatgtaaagctctgttgtgcgggaagaaggaagtgacggtaccgcacgaggaagccacggcaaactacgtgccagcagccgcgg

SEQ ID NO: 5162 - DNA, 490 bp, Unknown
  Ascusbbf_1341265, encodes 16S rRNA
agagtttgatcctggctcaggataaacgctgacggcgcacataagacatgcaagtcgaacggacttaactcattcttaacgactgagagcggttagtggcggactggtgattaatgtataagtaacctgcctatcagaggggaacaacagttggaaacgacatctaataccgcatatgccacgagaatcacatggttcacgtgggacaggagcatgtcgctgatagtcggacttatatctgattagctaattgttggggtaacgccctcccaaggcgacgatcagtatccgtactgagaggtaaaacgacaaaattgggactgggagacggcccaggggcgtacgggaggcagcggacgggaagattgcgcaatggaggaaacgctgaggaagtgacgccgcgggcaagaagaaggttatcggattgtaaactgctttagacagggaagaaaaaagacagtacctgtagaataagctccggctaactacg

SEQ ID NO: 5163 - DNA, 490 bp, Unknown
  Ascusbbf_1436504, encodes 16S rRNA
agagtttgatcatggctcaggatgaacgctagcggcaggcttaacacatgcaagtcgaggggcagcgcgggctagcaatactctggtggcgaccggcggaagggtgcgtaactcgtgcgcaacttgcccgccacttggggataggtactcggaacggtgtgtaatactccataacatatggtttcacatggcttcaaagtgaaagattcggtgttgacggatgggctcgggtaacattagctagtcgtcgtggtaacgtcacaccgagccaacgatgtgtaggggtgctgagaggaaggtcacccacactggaactgagacacggtccagactcctacgggaggcagcagtgaggaatattggtcaatggacggaagcctgaaccagccatgtagcgtgcaggaagacggccctatgggtcgtaaactgcttttccttgggggtaataagggtcacgtgtggccggatgagggtaccagaggaataagca

SEQ ID NO: 5164 - DNA, 490 bp, Unknown
  Ascusbbf_1341254, encodes 16S rRNA
agagtttgatcctggctcaggatgaacgctagctacaggcttaacacatgcaagtcgaggggcagcatgaatcaagcttgctttgtttgacggcgaccggcgcacgggtgagtaacgcgtgtccgaccttccctttagtcgagaatagcccggcgaaaatcggattaatgctcgatgttattccaagctcgcatcttagtcggatcaaaggtttatcgctataggatggggacgcgtctgattaggttgtcggcggggtaacggcccaccaaggccacgatcagtaggggttctgagaggacggtcccccacattggaactgagacacggtccagactcctacgggaggcagcagtgaggaatattggtcaatggccgagagtctgaaccagccaagtagcgtgaaggatgactgccctatgggttgtaaactgcttttgtacagggataaagtcgtcgacgtgtggcccgctgcatgtaccgtacgaat

SEQ ID NO: 5165 - DNA, 490 bp, Unknown
  Ascusbbf_1321686, encodes 16S rRNA
agagtttgatcctggctcaggatgaacgctagctacaggcttaacacatgcaagtcgaggggcatcatgtatctggcttgccatgtttgatggcgaccggcgcacgggtgcgtaatgcgtgttcgaccttccctttactcgagaatagcccatcgaaagatggattaatgccctatgttctccctttatcgcatgttattcggagcaaagatttatcgctagaggatggggacgcgtctgattagcttggcggcggggtaacggcccaccgtgcccacgatcagtaggggttctgagaggaaggtcccccacattggaactgagacacggtccagactcatacgggaggcagcagtgaggaatattggtcaatggacgagagtctgaaccagccaagtagcgtgaaggatgacggccctatgggttgtaaactgcttttgtacggggataaagtggggcacgtgtggtcggctgcaggtactgtacgaat

SEQ ID NO: 5166 - DNA, 490 bp, Unknown
  Ascusbbf_1321691, encodes 16S rRNA
agagtttgatcatggctcaggatgaacgctagcgataggcctaacacatgcaagtcgaggggcagcacatgaagtagctatacggatggtggcgaccggcgcacgggtgagtaacgcgtatgcaacctgcctacaacaggggaataacccgttgaaagacggactaataccccataacacagggatcccgcctgggaatatttgttaaagatttatcggttgtagatgggcatgcgttccattagcttgttggcggggtaacggcccaccaaggcaacgatggataggggatctgagagggtgatccccaacactggtactgagacacggaccagactcctacgggaggcagcagtgaggaatattggtcaatggacgcaagtctgaaccagccacgtcgcgtgaaggaagacggccctacgggttgtaaactgcttttgtgaggggataaagtgtagtacgtgtactattttgcatgtaccttacgaat

SEQ ID NO: 5167 - DNA, 490 bp, Unknown
  Ascusbbf_1436192, encodes 16S rRNA
agagtttgatcatggctcaggatgaacgctagcgataggcctaacacatgcaagtcgaggggcagcacatgaagtagcaatacggatggtggcggccggcccccgggggagtaacgcgtttgcaacctgcctacaacaggggaataacccgttgaaagacggactaataccccataacacagggatcccgcatgggaatatttgttaaagatttatcggttgtggatgggcatgcgttcaattagcttgttggtggggtaacggctcaccaagccaacgatggataggggaactgagaggtagatcccccacacaggtactgagaaacggaccaaactcctacgggaggcagaagtgaggaatattggtcaatggacgcaagtctgaaccagccaagccgcgtgaaggaagactgccctacgggttgtaaactgcttttgtaagggaataaagtgtagtacgtgtactgttttgcatgtaccgtacgaat

SEQ ID NO: 5168 - DNA, 486 bp, Unknown
  Ascusbbf_1321666, encodes 16S rRNA
agagtttgatcctggctcagaacgaacgctggcggcaggtcttaggcatgcaagtcgaacggacgacagagtggcttgccattcttcagttagtggcgcacgagtgagtaacgcgtgggaaactgcccttcactggggaataacgtctggacacggacgctaataccgcatacgccctcaagggtaaagatttctcggtgattgctgtgcccgctttggattgcctttttggtggggtaatggcataccacggcgctgatccatagctggtctgagaggacgaacagccacgctggaactgaggcacggtccagactcctacgggaggcagcagctaagaatattgggcaatggaggaaactctgacccagccatgccgcgtgaatgaagaaggccttcgggttgtaaagtgcggggagtcatgaagatgatgacagtagtgacagaaaaagcaccggctaacttcgtgccagcagccgcggtaat

SEQ ID NO: 5169 - DNA, 472 bp, Unknown
  Ascusbbf_1371394, encodes 16S rRNA
agagtttgatcctggctcagagcgaacgctggcggcatgcttaacacatgcaagtcgcacgaagggttcggccttagtggcggacgggtgaggaacgcggaggaatctatccatgggtgggggagaactctgggaaactggagcgaataccgcatgatacctgagggtcaaaggcgcaagtcgcctgtggaggagcctgcgttggatgagcttgttgggggggtaatggcctaccaaggcgatgatcgatagctggtcggagaggaggatcagccacactgggacggagacacggcccagactcctccgggcggcagccgtggggactcttggcccctgggggcaaccctgctccagccctgccgcgtgtgtgaagacggttttcggattgtaaagcactttcggcggggacgatgatgaccgtacccgcagacgacgccccggctaccttcgtgccagcagccgcggtaat

SEQ ID NO: 5170 - DNA, 486 bp, Unknown
  Ascusbbf_1436507, encodes 16S rRNA
agagtttgatcctggctcagaacgaacgctggcggcaggtcttaggcatgcaagtcgaacggacgacagagtggcttgccattctgaagttagtggcgcacgagtgagtaacgcgtgggaaactgcccttcactggggaataacgtctggaaacggacgctaataccgcatacgccctcaaggggaaagatttatcggtgatggatgttgccgcgttgcattagcttgttggtgggataatgggcaaacgaggtgatgagccatatctgttatgagaggacgctcagccacgctggaactgatacacggtccagactccgacgggaggcagcagctaagaatattgggaaatggaggaaactctgaccaagccatgccgcgtgaatgaagaaggccgtcgggttgtaaagttcttttagtcatgaagatgatgacagtagtgacagaaaaagcaccggctaacttcgtgccagcagccgcggtaat

SEQ ID NO: 5171 - DNA, 490 bp, Unknown
  Ascusbbf_1321647, encodes 16S rRNA
agagtttgatcatggctcaggatgaacgctagcggcaggcttaacacatgcaagtcgaggggtaacgcggggtagcaataccctggcgacgaccggcgcacgggtgcgtaacgcgtatgcaacctacctgtcacagggggataacggagagaaatttccactaataccccatattgttcttctttcgcatgctaggctaacgaaagctacggtggttacggatgggcatgcgtgatattagctagttggtaaggtaacggcctcccaaggcgacgatgtctaggggagctgagaggcagatcccccacactggaactgagaaacggtcaagactcctacgggaggaagcagtgaggaatattggtcaatggacggaagcctgaaccagccaagccgcgtggaggatgaaggtcctatgggttgtaaactgcttttgtacgggggtaatatgggcgtcgcgaagccctatgtgggtatcggacgaataagg

SEQ ID NO: 5172 - DNA, 472 bp, Unknown
  Ascusbbf_1321641, encodes 16S rRNA
agagtttgatcctggctcagagcgaacgctggcggcatgcttaacacatgcaagtcgcacgaaggggtcggcctgagtggcggacgggggagtaacgcggaggaagctatccaggggtgggggagaactctgggaaactggagcgaagaccgcatgatacctgagggtcaaaggcgcaagtcgcctgtggaggagcctgcgtccgattagcttgttggtggggtaatggcctaccaaggcgatgatcgatagctggtctgagaggaggatcagccacactgggacggagacacggcccagactcctccgggcggcagccgtggggactcttggcccctggcggccaccctgctcccgccctgccgcgtgtgtgacgacggttttcggattgtacagcactttcggcggggacgatgatgaccgtacccgcagaagacgccccggctaacttcgtgccagcagccgcggtaat

SEQ ID NO: 5173 - DNA, 490 bp, Unknown
  Ascusbbf_1316140, encodes 16S rRNA
agagtttgatcctggctcaggatgaacgctggcggcgtgcctaacacatgcaagtcgaacggggatattccgccgtttgaagcttcggcagaaaacatgggatatcttagtggcgaacgggtgagtaacgcgtgggcaacctgccccgtaccgggggatagcagttggaaacgactgataataccgcataagcgcacagcacggcatcgtgcagtgtgaaaaactccggtggtacgggatgggcccgcgtctgattagctagttggcggggtaacggcccaccaaagcgacgatcagtagccggcctgagagggcggacggccacattgggactgagacacggcccagactcctacgggaggcagcagtggggaatattgcacaatgggggaaaccctgatgcagcgacgccgcgtgagggatgaaggccttcgggttgtaaactcctttcgctagggacgaagatgtattttgacggtacctggagaag

SEQ ID NO: 5174 - DNA, 486 bp, Unknown
  Ascusbbf_1321847, encodes 16S rRNA
agagtttgatcctggctcagaacgaacgctggcggcaggtcttaggcatgcaagtcgaacggacgacagagtggcttgcccttcttaagttagtggcgcacgagtgcgtaacgcgtgggaaactgcccttcactggggaataacgtctggaaacggacgttaataccgcctccgcccgcaaggggccagatttatcggtggtggatgtgcccgcgttggattagcttgttggtggggtaatggactcccacggcgatgatccatagctggtctgagaggacgatcagcaacgctggaacttagacacggtccagactcctacgtgaggcagcagctaagaagattgggcaatggaggaaactctgacccagacatgccgcgtgaaggaagaaggccttcgggttgtaaagttcttttagtcatgaagatgatgacagtagtgacagaaaaagcaccggctaacttcgtgccagcagccgcggtaat

SEQ ID NO: 5175 - DNA, 490 bp, Unknown
  Ascusbbf_1371895, encodes 16S rRNA
agagtttgatcatggctcaggacgaacgctggcggcgtgcttcatacatgcaagtcgaacggggtccattcagtggcaacactgaggaagatctagtggcgaacgggtgagtaacacgtgaggaacctatcccggtctctggaataacaagtggaaacatttgctaataccgtatgccgtcgtctgcttgaatgaagaagtgacgaaagattcacccgattgggcgggcctcgcgacctatcagtttgttggtggggtagtggcataccaagtcatagacgagtagctggtctgacagagtgacagacccaactcggcctgagacacggcccagactcctacgggaggcagcagtagggaatctagcgaaatcggcgcaagaccgacgcagcaacgccgcgtgcgggaagaaggctcacgggttgtaaaccgctatcagtaggaacgaatttgacggtacctgcagaagaaggtgcgtccaacaacgtgc

SEQ ID NO: 5176 - DNA, 490 bp, Unknown
  Ascusbbf_1321842, encodes 16S rRNA
agagtttgatcatggctcaggatgaaagagggcggagtgcagaaaaaaggaaaggagagcgagaatttgtggaagtttaccttcggggaaacggaagcgaaggacagaggaggacggttgaggtacgcgtatggaagctgcccttcacacggtgagagagagagtaaagggggagtaagagacgagagtacggaccagcacatggtgatccggggaaagctttatcggtgaaggaggaacctgcgtctgattagctagttggtgaggtaatgccgcaacaaggcaatgatcagtagccgagctaagagggggaccctcccaactgggactgagcaacggcaccccctcctacgggcggcagcagtgggggatattgcgcaatgggcgaaagcctgacgcagcaacgccgcgtgaacgagtacgctcttcgtagtgtaaagttctgtcctatgcgaagaagatgacggtaccataggaggaagccccggct

SEQ ID NO: 5177 - DNA, 490 bp, Unknown
  Ascusbbf_1436050, encodes 16S rRNA
agagtttgatcctggctcaggatgaacgctagcggcaggcttaacacatgcaagtcgaggggcagcgcggggtagcactcctctgtcggcgcccgtcggaggggtgcgtaacgcgtgagcaacttgcccttcactgggggataggcactggaaacggtgtgtaatactccataacatatggattcacatggattcatattgaaagattcgttggtgacggatgcgctcgcgtaacattagctagtcggcggggtaacggcccaccgaggctacgatgtttaggggttctgagaggcaggtcccacacaatggaactgagaaacggtccagactcctacggaaggcagcagtgaggaatattggtcaatgggcggaagcctgagccagccaggccgcgtgaaggaataaggcccgatgggtcgtaaactgcttttccaggagggcaataagggtaacgtgtggcccgatgagagtagcaggggaataagca

SEQ ID NO: 5178 - DNA, 490 bp, Unknown
  Ascusbbf_1343677, encodes 16S rRNA
agagtttgatcctggctcaggatgaacgctagcggcaggcttaacacatgcaagtcgaggggtaacgcggggtagccatactctggcgacgaccggcgcacgggtgcgtaacgcgtatgcaacctacctgtcacaggggtataacggagagaaatttccactaatcccccatattgttagagattcgcatgtttctctaacgaaagcttcggtggttacggatcggcatgcgtgacattagctagttggtaagctaacggcataccaacgcaacgatgactaggggagctggagggcttatcccccaaaatgggacggagacacggaccagactcgtacgggaggaagcagtgaggaatattgatcaatggacggaagtcggaaccagccatgccgcgtgaaggatgaaggtgctatggattgtaaacttcttttgtcggagggtaaaaaaggccacgtgtggcttcttgaaagtatcggacgaataagc

SEQ ID NO: 5179 - DNA, 490 bp, Unknown
  Ascusbbf_1371912, encodes 16S rRNA
agagtttgatcatggctcaggatgaacgctggcggcgcgcctaacacatgcaagtcgaacggttaaggcgccttcgtgcgcctataccgtggcgaacggctgagtaacacgtgggcaacctgcccctcgcacctttacagcctcgggaaaccgtggatgatcccggatcctccgcctcccccgcatggggaggccgggacagcccgcacggcgagggatggacccgccccctgttatctagttgcctgggcagcggcccaccaacgcgatgatgggtagctgggttgagagaccgaccggcccgagtgggagcgagaaacggcccagactcctacgggaggaagcagtggggaatcttgcacaatgggcggaagccggatgcagcgacgccgcgtgcgggacgaaggccttcgggctggaaaccgctttcagcagggacgaggcgaaagtgacggtacctgcagaagaagccccggctaactacgtgcca

SEQ ID NO: 5180 - DNA, 485 bp, Unknown
  Ascusbbf_1372081, encodes 16S rRNA
agagttgatcatggctcagaacgaacgctggcggcaggtcttaggcatgcaagtcgaacggacgacagagaggcttgccattctgaagttagtggcgcacgagtgagtaacgcgtgggaaactgcccttcactggggaataacgtctggaaacggacgctaataccgcatacgcccgcaaggggaaagatttatcggtgatggatgtgcccgcgttggattagcttgttggtggggtaatggcctaccaaggcgatgatccatagctggtctgagaggacgatcagccacgctggaactgaggaaaggttccgacttcttacggggggaggaggtaaggataatgggccatggagggaactccgaaccaggcatggcgcgggaaagaagaagggccttggggtggtaaggttttttagtcatgaagatgatgacagtagtgacagaaaaagcaccggctaacttcgtgccagcagccgcggtaat

SEQ ID NO: 5181 - DNA, 490 bp, Unknown
  Ascusbbf_1343582, encodes 16S rRNA
agagtttgatcctggctcaggatgaacgctagcggcaggcttaacacatgcaagtcgaggggcagcgcggggtagcaatcctctggcggcgaccggcagaagggtgcgtaacgcgtgagcaacttgcccgtcactgggggataggcactggaaacggtgtgtaatactccattacatatggattcacatggttttatattgaaagattcgttggtgacagatgggctcgcgtaacattagcgagtcggcggggtaacggcccaccgagcctacgatgtttaggggttctgagaggaaggtcacacaacatggaactgagacacggtccagactcgtacgggaggcagcagtgaggaatattggtcaatgggcggaagcctgaaccagccatgccgcgtgcaggaagaaggcccgatgggtcgtaaactgcttttccttgagggcaataagggtcacgtgtggcccgatgagagtagcaggggaataagca

SEQ ID NO: 5182 - DNA, 486 bp, Unknown
  Ascusbbf_1372095, encodes 16S rRNA
agagtttgatcctggctcagaacgaacgccggcggcaggtcttatgcatgcaagtcgaacggacgacagagtggcttgccattctgatgttagtggcgcacgagtgagtaacgcgtgggtaactgcccttcactggggaataacgtctggatacggacgctaataccgcatacgcccgcaaggggaaagatttatcggtaatggatgtgcctgcgttggattagcttgttggtgtggtaatggcctaccatggctatgacccatagctggtctgagaggaagatcagccacgctggaattgagacacggaccagactcctacggggggcagcagctaagaatagtgggcaatggaggaaactctgacccagccatgccgcgtgaatgaagaaggccttcggggtgtaaagttcttttagtcatgaagatgatgacagtagtgacagaaaaagcaccggctaactgcgtgccagcagccgcggtaat

SEQ ID NO: 5183 - DNA, 490 bp, Unknown
  Ascusbbf_1323134, encodes 16S rRNA
agagtttgatcctggctcaggatgaacgctggcggcgtgcctaatacatgcaagtcgagcgagaaatctttcagacgattcttcgtatgagtcaggaagatggaaagcggcggacgggtgagtaacgcgtaggcaacctgccctcagcagagggatagccattggaaacgatgattaaaacctcataatgctgcagtaacacatgttacagcagccaaagattcatcggctggggatgggcctgcgtctgattaaccggttggtgaggtaacggttcaccaaggtaacgatcagtagccgaccttggaggggaaacgcgcacataggaactgagacacggtgcaaacttctacggaaggcagcagtaaggaatcttgcacaatgggggaaaccctgatgaagcaacgccgcgtgaacgatgaaggccttagggttgtaaagttctgatctgtgggaagaagaaagtgacggtaccacaggagaaagcccc

SEQ ID NO: 5184 - DNA, 165 bp, Unknown
  Ascusbbf_1385670, encodes 16S rRNA
agagtttgatcatggctcagacatatcgaaacgaatcattgaatcttcagaaccgaatagttcaaaggctaattgtttcgctaactcagttttacctacaccagttggccctacaaataggaacgaaccgattggacgatttttagggccagcagccgcggtaat

SEQ ID NO: 5185 - DNA, 490 bp, Unknown
  Ascusbbf_993699, encodes 16S rRNA
agagtttgatcatggctcaggatgaacgctggcggcgcatttaagacatgcaagtcgaacgaaaatttatgcttaaagagttgattagtttactaagatacaatttattataaattttagtggcggactggtgagtaatacataggtaatctaccttttagaggggggataactagaagaaattctagctaataccgcgtaagaccacatctaggcatctagaagaggtcaaagaagtaattcgctaaaagatgagcctgtggctgattagttagttggtggggcaatggcctaccaagacgatgatcagtagccggactgagaggttgaacggccacattgggactgagataaggcccagacccctacgggaggcagcagtgaggaatattggtcaatggtcgggagactgaaccagccaagtagcgtgcaggacgacggccctacgggttgtaaactgcttttatgcggggataaaggacgccacgtg

SEQ ID NO: 5186 - DNA, 490 bp, Unknown
  Ascusbbf_1322285, encodes 16S rRNA
agagtttgatcctggctcaggatgaacgctagcggcaggcttaacacatgcaagtcgaggggcagcgcggggtagtaatactctggcggcgaccggcggacgggtgcgtaacgcgtgagcaacttgcccgtcactgggggataggcactggaaacggtgtgtaatactccataacatatggattcacatggattcatatttaaagattcgttggtgacggatgggctcgcgtaacattagctagtcggcgtggtaacggcccaccgaggctacgatgtttaggggttctgagaggaaggtgcgccataagggaactgagaaacggtccggcatcctacgggaggcagcagtgaggaataatggtcaatgggcgaaagcctgaaccagccatgcagcgtgcaggaataaggccctatgggtcgtaaactgcttttccttgagggcaataagggtcacgtgtggcccaatgagagtatcaggggaataagca

SEQ ID NO: 5187 - DNA, 490 bp, Unknown
  Ascusbbf_1324531, encodes 16S rRNA
agagtttgatcctggctcaggatgaacgctggcggcgtgcttaacacatgcaagtcgaacggagttatctcgctgattcgatctttctcaaatcttgagataacttcgtgtcggacgtgtgcgtaacgcttgtataacctgccttctaccgggggataacacttataactagttgctactaccgcataagcgcccgatcccgcatgggaaagtgtgaaaaactccgatggtataaaatggagccgcgtctgattagttagttggtgaggtaacggcccaccaagtcaacgatcagtagccggactgagagggtgacaggcaacattgggactgggacacggcccaaacgcatacgggaggcaggagtggggaatagtgcacaatgggggaaacccggaagcagcgacgccgggggggtgaagaagtatgtcggtatggaaagcaagatcagaaaggaagaaaaaaatgacggtactggactaagaagccc

SEQ ID NO: 5188 - DNA, 490 bp, Unknown
  Ascusbbf_1342537, encodes 16S rRNA
agagtttgatcatggctcaggatgaacgctggcggcgtgcttaacacatgcaagtcgaacggagttatctcgctgaggctatcttgctcaaatcttgagataactttgtggcggacgggtgagtcacgcgtggatcacctgccttatactgggggataacacttagaaataggtgctaataccgcataagcgcacgttcccgcatgggaaagtgtgaaaaactccggtggtgtaaagtggatccgcgtctgattagatagttggtgaggtaacggcccaccaagtcaacgctcagtagccgacctgagagggggaacggccacatcgggactgagacacggcccaaacaccgacgggaggcagcagtggggaagagtgcacaatgggggaaaacctgaggcagcgacgacgcgggggtgaagaaggagttcggtaggtaaagctcgatcagcaaggaagaaaaaaatgacggtacttgactaagaagccc

SEQ ID NO: 5189 - DNA, 486 bp, Unknown
  Ascusbbf_1342552, encodes 16S rRNA
agagtttgatcatggctcagaacgaacgctggcggcaggtcttaggcatgcaagtcgaacggacgacagagtggcttgccattctgaagttagtggcgcacgcgtgagtaacgcgtgggaaactgcccttcactggggaataacgtctggaaacggacgctaataccgcatacgcccgcaaggggaaagatttatcggtgatggatgtgcccgcgttgggttggcttgtggttgggttaagggcttaccaaggtgatgatccatcgctggtctgagaggacgatgagccacgcgggaacggagacacggtccagactcctacgggaggcagcagcacagaatattgggcaagggaggaaactctgacccagccaggccgcgtgaatgaagaaggccttcgggttgtaaagttcttttagtcatgaagatgatgacagtagtgacagaaaaagcaccggctaacttcgtgccagcagccgcggtaat

SEQ ID NO: 5190 - DNA, 490 bp, Unknown
  Ascusbbf_1372426, encodes 16S rRNA
agagtttgatcctggctcaggataaacgctggcggcgcacataagacatgccagtcgaacggacttaactcattcttaacgattgagagcggttagtggcggactggtgagtaatgtataagtaacctgcctatcagaggggaacaacagttggaaacgactgctaataccgcatatgccacgagaatcacatggttcaagtgggaaaggagcaatccgctgatagatggacttatatctgattagctggttgtttgggtaacgtcctaccacggcgacgaccagtagccggactggaaggttacccggccacatgtggactgggatacggcccagactccgacgggcggcagcagtcgggaagattgcgcaatggaggaacctctgacgcagtgacgccgcgtgcaggaagaaggttttcggattgtaaactgctttagacagggaagaaaaaagacagtacctgtagaataagctccggctaactacg

SEQ ID NO: 5191 - DNA, 490 bp, Unknown
  Ascusbbf_1372427, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggttgggcatgcgtgactttagctagttggtaaggtaacggcttaccaaggcgacgatgtctaggggagctgagaggcttatcccccacacaggtacagggaacaggaccaaactcctaagggaggcaggagggagcaatattggtcaatggacggaagtctgaaccagccatgccgagtggaggaagaaggacctatgggttgtaaactcctttcgttcgggggtaataagggctttgcgaagcccgatgagagtagcggacgaataagc

SEQ ID NO: 5192 - DNA, 490 bp, Unknown
  Ascusbbf_1435519, encodes 16S rRNA
agagggggagaagggcggaggaggaaagagagagagaggaggaaaaaaggaaaggagaggggaaggaggaattaggagtaaacagatagaaagaaaaaagagaaaaagaaagaaaaaaataaccacccttccctatagtaaaggatagcccggcgaaagtcggattaatactctatgttattcaatgcggacatctaagttgaatcaaagatttatcgctataggatggggatgcgtctgattaggttgttggcggggtaacggcccaccaagcctacgatcagtaggggttctgagaggaaggtctcccacattggaactgagacacggtccaaactcctacgggaggcagcagtgaggaatattggtcaatgggcgagagcctgaaccagccaagtagcgtgcaggatgacggccctatgggttgtaaactgcttttatacggggataaagtgagggacgtgtcccttattgtaggtaccgtatgaat

SEQ ID NO: 5193 - DNA, 490 bp, Unknown
  Ascusbbf_1435542, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaaagtcggattaataccctattttttccgtttaggacatctgaagtggaataaagatttatcgctaagggatgggaatgcgtcgaattaggttgttggcggtgtaacggcccaccacgccatcgctcagtaggggttctgagaggaaggtccgcaaccgtggaactggaaaaaggaacaaaatacgacgggaggcagcagtgaggaagattggtcaatgggcgagagcctgaaccagccaagtagcgtgcaggatgacggccctatgggttgtaaactgcttttgcatgggaataaagtgagggacgtgtccctttttgtatgtaccatgagaat

SEQ ID NO: 5194 - DNA, 490 bp, Unknown
  Ascusbbf_1342219, encodes 16S rRNA
agagtttgatcctggctcaggctgaacgctagcggcaggcttaacacatgcaagtcgaggggtaacgcggggtagcaatactctggcgacgaccggctcacgggtgcgtaacgcgtatgcaacctacctgtaacaggggtataacggagagaaatttccactaatcccccatattgttagagattcgcatgtttctctaacgaaagcttcggtggttacggatggtcatgcgtgacattagctagttggtacggtaacggcttaccaaggcgacgatgtctaggggagctgagaggcttatccccacagctggtacgacgacacgaaccagactcctacgagaggcagcagtgcggactattggtcaatggacggaagtctgaaccagctatgccgcgtggaggaagaaggtcctatgggttgtaaactccttttgttcgagagtaataagaggcttgcgagcctcgatgagagtagcggacgaataagc

SEQ ID NO: 5195 - DNA, 490 bp, Unknown
  Ascusbbf_1324613, encodes 16S rRNA
agagtttgatcctggctcaggatgaacgctggcggcgtgcctaacacatgcaagtcgaacgattaaaccgccttcgggcggatataaagtggcgaacgggtgagtaacacgtgaccaacctaccccgcacatcgggacagccctccgaaagggggattaataccgaatactccgtatttttcgcatgattaatacgggaaacctcttgcggggctggatggggtcgcggcgcattaggtaggagtcgggtcatcggcccgtctagcccaagacgggtagccgggttgagagaccgagcggccacattgggactgagagacggcccagactcctacgggaggcagcagtggggaatattgcgcaatgggggcaaccctgacgcggcaacgccgcgtgcgggaggaaggcattcgtgtcgtaaaccgctttcagcagggaagacatcgacggtacctgcggaagaagcaccggctaactacgtgccagcacc

SEQ ID NO: 5196 - DNA, 490 bp, Unknown
  Ascusbbf_1435567, encodes 16S rRNA
agagtttgatcatggctcaggatgaacgctagctacaggcttaacacatgcaagtcgcggggcatcatggcatgtagcaatacatgctgatggcgaccggcggatgggtgagtaacgcgtatccaacctggccctatctcgggtacagcccctcgaaagggggataaattcccgatgttccctgggatccgcatgttttcccggccaaaggcatttgtcggatggggagggggatgggttccattaggcatgcgcggggttaccgaccccccgaccctaggatgtttaggggttcggagggaaaggtcccccacacgggaattaagacacgggccagactcctacgggaggcagcagtgaggaatattggtcaatgggcggaagcctgaaccagccatgccgcgtgcaggaataaggccctatgggtcgtaaactgcttttccttgagggcaataagggtcacgagtggcccgatgagagtatcagggga

SEQ ID NO: 5197 - DNA, 490 bp, Unknown
  Ascusbbf_1435266, encodes 16S rRNA
agagtttgatcctggctcagattgaacgctggcggcaggcctaatacatgcaagtcaacgggaacagggaggaagcttggtttctcttctgacggggggggggagggggaggaagggctgggaaaatgcctggtagagggggacaacaggtggaaacggctgctaataccgcataatacctgagggttaaaaacgacaggcggtatcagatggcgccaggttggattagctatgaggtgaggtaaaggcccacctaagcgatggactctagctggtctgagagggtgatcagccacattgggactgagacacggcccagactcctacgggaggcagcagtagggaatattgcacaatggggggaaccctgatgcagccatgccgcgtgtgtgaagaaggccttcgggttgtaaagcactttcacaggggaggaaggatgacgttaccctgagaagaagcaccggctaactccgtgccagcagccgcggta

SEQ ID NO: 5198 - DNA, 490 bp, Unknown
  Ascusbbf_1372709, encodes 16S rRNA
agagtttgatcatggctcaggacgaacgctggcggcgtgcctaacacatgcaagtcgaacggaacttatgtagaagattctttcgggatgattgtgatgaagtgtagtggcggacgggggaggaacgcgggaggaaccggcctgtgagaggggaataacaatatgaaaagattgctaataccgcataacatatatttgtcgcatggcagatatatcaaagagtttatcgctcaaagatggactcgcggccgattagttagctggtgaggaaacggctcaccaagaccgcgatcggtagccggctgagagggtggaacggccaaattgggactgggacacggaccagactcctacgggaggcagcagtgggggagattgcgcaatgcgggcaaccctgacgcagcaacgccgcgtgaaggatgaaggttttcggattgtaaacttcttttattaaggacgaaaaatgacggtacttaatgaataagctccg

SEQ ID NO: 5199 - DNA, 490 bp, Unknown
  Ascusbbf_1435164, encodes 16S rRNA
agagtttgatcctggctcaggataaacgctggcggcgcacataagacatgcaagtcgaacgaacttaatcgaaagtttacttttgaagcggttagtggcggactggtgagtaacgcgtaagcaatctgcctatcagaggggaataacagtgagaaatcattgctaataccgcataagctgtgagtatcgcatgctacaaatagaaaaggagcaatccgctgatagatgagttcgcgtaagatgagatggtgagtggggtaacggcataccaagacgatgatcagtagccggactgagaggttacacggccgcatcaggactggggtgcgacccagactcctacgagcggcagcagtcgggaatgtttcacaatggaggaaactctgacgcagggacgccgcgtgcaggaagaaggttgtcggattgtaaactgctttagataggaaagaaaaaaaataacggtacctatagaataagctccggctaacta

SEQ ID NO: 5200 - DNA, 486 bp, Unknown
  Ascusbbf_1325216, encodes 16S rRNA
agagtttgatcctgtctcagaacgaacgctgtcggcaggtcttcgtcatgcaagtcgaacggacgacagagtggcttgccattctgaagttagtggctcacgagtgagtaacgcttgggaaactgcccttcactggggactaacatctgtaaacgtacgctaatacctcatactcccccaaggggatatatttatctgtagttgattttcccgcttttgattagcttttttgtggtgtaatgacctaccaaggcgattatccctagcttgtctgagaggactatcagccacgctggaacttagacacggtccagacgcatacgggaggcagcagctaagaatagtgggcaatggaggaaactctgacccagccatgccgcgtgaatgaagaaggccttcgggttgtaaagttcttttagtcatgaagatgatgacagtagtgacagaaaaagcaccggctaacttcgtgccagcagccgcggtaat

SEQ ID NO: 5201 - DNA, 490 bp, Unknown
  Ascusbbf_1372823, encodes 16S rRNA
agagtttgatcctggctcaggataaacgctggcggcgcacataacacatgcaagtcgaacggacttaatcgaaagcattcttttgacgcggatagtggcggactggtgtgtaacgcgtaagcactctgtctatcagaggggaataacagtgagaaatcattgctaataccgcataagctgtgagtatcgcatgatacaaatagaaaatgagcaatccgctgatagatgtgcttgcgtctgattagttagtaggtggggtaacggcctaccaagacgatgatcagtagccggactgagaggttaaacggcccgattgagactgcgatgcggcccagactcctacgggaggcagcagtcgagaatattgcgaaatggaggaaccgcggacgcagtgaaggcgcgtgcaggaagaaggttttcggattgtaaactgctttagatagggaagaaaaaaatgacggtacctatcgaataagctccggctaactac

SEQ ID NO: 5202 - DNA, 273 bp, Unknown
  Ascusbbf_1325220, encodes 16S rRNA
agagtttgatcatggctcaggatgaacgctagcgacaggcttaacacatgcaagtcgaggggcagcatggaggtagcaatacttctgatggcgaccggcgcactggtgagtaacacgtatgcaacctgcccctggttgggggataacccgcggaaaggcgaccgaataccgggtatgcaccctggcttgatgacttgtgcgtggtagcacgtggtccagggagagggttgcggggcattagccatcggccagctccacgccagcacaaggcgt

SEQ ID NO: 5203 - DNA, 490 bp, Unknown
  Ascusbbf_1324561, encodes 16S rRNA
agagtttgatcctggctcaggatgaacgctggcggcgtgcctaatacatgcaagtcgaacgaggtttctcttcggggaaaccgagtggcgaacgggtgagtaacacataggtaatctacctttcagactgggatacccaagagaaattttggctaataccgtctacaatcatttctcctcatggagatttgatgaaaggggctccaaagcctcgctgttagatgaacatgtggcacattagctagttggtgaaataacagccaaccaaggcgaagctgtgtagccgatctgagaggataatcggccacaaggggacggagacaccgcccgatctcctacgtgaggcagcagtagggagttttcggcaattggggaaaccctgaccgtgcaacgccgcgtgatttaggaggccctctgggtcggaagaatctgttgtaaaggagaagtggtagtgggaggaaatgcccattatttgatagtactttattag

SEQ ID NO: 5204 - DNA, 490 bp, Unknown
  Ascusbbf_1342517, encodes 16S rRNA
agagtttgatcctggctcaggataaacgctggcggcgcacataagacatgcaagtcgaacggacttaactcattcttagcgatttcgagcggttagtggcggactggtgagtaatatataagtaacctgcctctcagaggggaacaacagttggaaacgactgctaataccgcatatgccacgagaatcacattgttcaattgggaaaggagcaatccgctgatagatggacttctatctgattagctagttggtggggtaacggcataccaaggcgacgatcagtagccggactgagaggttaaacggccaaattgggactgagaaccggcccagactcctgcgggaggcagcagtagggaatattgcgcaatggaggaaactctgacgcagtgaggccgcgtgcaggaagaaggttttcggattgtaaactgctttagacagggaagaaaaaagacagtatctggagaataagctccggctaactacg

SEQ ID NO: 5205 - DNA, 490 bp, Unknown
  Ascusbbf_1342505, encodes 16S rRNA
agagtttgatcctggctcaggataaacgctggcggcgcacataagacatgcaagtcgaacggacttaactcattcttaacgattgagagcggttagtggcggactggtgagtaatgtataagtaacctgcctatcagaggggaacaacagttggaaacgactgctaataccgcatatgccacgagaatcacatggttcaagtgggaaaggagcaatccgctgatagatggacttatatctgattagctagttggtggggtaacggcctaccaaggcgacgatcagtaaccggactgagaggttgaacggccacattgggaatcagaaacggcacaaacgccgacggaaggacgcagtagggaagatgacggaatggaggaaacgcggacgcagtgacgccgcatgcaggaagaaggttttcggattgtaaactgctatagacagggaagaaaaaagacagtacctgtagaataagctccggctaactacg

SEQ ID NO: 5206 - DNA, 490 bp, Unknown
  Ascusbbf_1372712, encodes 16S rRNA
agagtttgatcatggctcaggatgaacgctggcggcgtgcttaacacatgcaagtcgaacggagttatctcgctgaggagagcttgctcaaatcttgagataacttagtggggaaggggggggaactcggtgataaactggcttataaccgggggtaaacactagaaattggtgctaataacgcctaagcgcacggacccgcctgggaaagggtgaaaaaaccccgtgggttaagatgggtccgggtccgaatagaaaggtggggaaggaaacgcccaacaaagccaccgatcgtaagccggcctgagagggtgaacggccacattgggactgcgacacggcccaaactcctacgggaggcagcagtggggaatattgcacaatgggggaaaccctgatgcagcgacgccgcgtgagtgaagaagtatttcggtatgtaaagctctatcagcaaggaagaaaaaaatgacggtacttgactaagaagccc

SEQ ID NO: 5207 - DNA, 490 bp, Unknown
  Ascusbbf_1372357, encodes 16S rRNA
agagtttgatcctggctcagaacgaacgctggctgcaggcttaacacatgcaagtcgcggggcatcatggcatgtagcaatacatgctgatggcgaccggcggatgggtgagtaacgcgtatccaacctggccctatctcgggtacagcccctcgaaagagggattaatcctcgatgttctctgggatccgcatgttttccagggcaaaggcatttgtcggttagggatggggaggtgtgcttttagtcagtcggcggggtcacggcccaccgcgccggcgatggataggggttctgagtgaaaggccccccacactgggactgagacacggcccaaactccgacgggaggaagcagtgaggaatattggtcaatggcggtgacgctgaaccagccaagtagcgtgagggattacggccctatgggttgtaaacctcttttgttagggagcaaccggtggcactagtgccattctgcgagtaccttacga

SEQ ID NO: 5208 - DNA, 490 bp, Unknown
  Ascusbbf_1342343, encodes 16S rRNA
agagtttgatcatggctcaggataaacgctggcggcgcccataagacatgcaagtcgaacggacttaactcattcttaacgattgagagcggttagtggcggactggtgagtaatgtataagtaacctgcctatcagaggggaacaacagttggaaacgactgctaataccgcatatgccacgagaatcacatggttcaagtgggaaaggagcaatccgctgatagatggacttatatctgattagctagttggtggggtaacgacctaccaatgcgacgatcagtagccggactgagaggttagacggccacatatggactcaggtacggcccaactgcctgcgggaggcagcagtcaggaataatgcggaatggaggaaactctgacgcagtgacgccgcgggcaggaagaaggttttctgattgtaaactgctttagacagggaagaaaaaagacagtacctgtagaataagctccggctaactacg

SEQ ID NO: 5209 - DNA, 490 bp, Unknown
  Ascusbbf_1342177, encodes 16S rRNA
agagtttgatcctggctcaggacgaacgctggcggcgtgcttaacacatgcaagtcgaacggtgaagcccagcttgctgggtggcttagttgcgaacgggtgcgtaacacgttagtaacctgcccctctctctgggataactccgggaaaccggtgctaatacagtatatgactacttcctgcatgggatggtggtggaaagtttttcggtgggggttggactcgcgggctatcagcttgttggtggggtaatggcctaccaaggcgacgacgggtagccggcctgagggggcgaccggccaccgtgggactgagacacggcccggactactacgggaggcagcagtgtggaatatggcacaatgggcgaaagcctgatgcagcgacgcggcgtgagggatgacggccttcgggttggaaacctcattcagcagggacgaagcttttgtgacggtacctgcagaagaagcaccggctaactacgtgccag

SEQ ID NO: 5210 - DNA, 490 bp, Unknown
  Ascusbbf_1372579, encodes 16S rRNA
agagtttgatcatggctcaggatgaacgctagcggcaggcttaacacatgcaagtcgaggggtaacgcggggtagcaatactttggcgtcgaccggcgcacgggtgcgtaacgcgtatgcaacctacctgtaccaggggtataacggtgagaaatttccactaatcccccatattgttagagatccgcatgtttctctaactaaagtttcggtggtttcggatgcgcatgcgtgacattcgctagttgttacggtaatggtttaccaaggcgacgatgtctaggggagctgagaggcatatcacccacactggaactgagacacggaccaaactcctacgggaggcagcagtgaggaatattggtcaatggacgagagtctgaaccagccatgccgcgtggaggaagacggtcctatgggttgtaaactccttttgtgcgggggtaatgagaggcatgcgagccgcaatgagagtatcggacgaataagc

SEQ ID NO: 5211 - DNA, 471 bp, Unknown
  Ascusbbf_1324423, encodes 16S rRNA
agagtttgtcctggctcagagcgaacgctggcggcatgcttaacacatgcaagtcgcacgaaggtttcggccttagtggcggacgggcgagtaacgcgcaggaatctatccatgggcgggggataactctgggaaactggagctaataccgcatgatacctgagggtcaaaggcgcaagtcgccggtggaggagcctgcgttcgatcagctagttggtggggtaatggcctaccaaagcgacgatcgatagctggtctgagcggatgaccagccacactgggattgagtcacggcccagacacctacgggaagcggcggtggggaatagtggacaatgggggcgacccagatccggcaatgccgcgtgtgtgaagaaggttttcggagaggaaagcacattcggcggtgacgatgatgacggtacccgcagaagaagccccggctaacttcgtgccagcagccgcggtaat

SEQ ID NO: 5212 - DNA, 490 bp, Unknown
  Ascusbbf_1342176, encodes 16S rRNA
agagtttgatcctggctcaggatgaacgctagcggcaggcttaacacatgcaagtcgaggggtaacgctgggtagcaatactctggcgactaccggcgcacgggtgcgtaactcgtatgcaacctacctttaacatgggtataacggagagaaatttccactaatcccccatattgttagagattcgcatgtttctctaacgaaagcttcgttggttacggatgggcatgcgtgactttagctagttggtaaggtagctgcttaccaaggcgacgatgtttaggggagctgtgaggattaccccgcaagatggtactgagacacggaccatacgcctccgggaggcagcagtgaggaatattggtcaatggacggaagtctgaaccagccatgccgcgtggaggaagaaggtcctatgggttgtaaactccttttgttcgagagtaataagaggcttgcgagcctcgatgagagtatcggacgaataagc

SEQ ID NO: 5213 - DNA, 490 bp, Unknown
  Ascusbbf_1372513, encodes 16S rRNA
agagtttgatcctggctcaggacgaacgctggcggcgtgcctaacacatgcaagtcgatcgagaattcttgatttgattctttcgggatgacgattaagaaggaaagcggcggacgggtgagtaacgcgtgagtaacctgccccatagaacggaatagcctagtgaaaactgtaataataccgtatgaagcagcagcaccgcatgatgcagctgttaacgatttatcgcgatgggatggactcgcttctgattatatggttggcggggtaacggccccccaagtcgacgatcagtcgccgaacggagtggttgatcggacaaattgggactgggacacggccccgactcctacgggaggcagcagtgggggatattgcacaatgggggaaacccggatgcagcaacgccgcgtgaaggaagaaggtcttcggattgtaaacttttgtctttagggaagaaacaaatgacggtacctaaggaggaagccac

SEQ ID NO: 5214 - DNA, 490 bp, Unknown
  Ascusbbf_1435411, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtcacaggggtatagcggagagaaatttccactaatcccccatattgttagagattcgcatgtttctctaacgaaagcttcggttgttacggatgggcatgcgtgacattagctagttggtaaggtaaaggcttacccaggcgacgatgtcttagggggccgcggggctaaatccccaacactggaactgagacacggaccagacgcctacgggaggcagcagtgaggaatattggtcaatggacggaagtctgaaccagccatgcagcgtggaggaagaaggccctatgggttgtaaactccttttgttcgagagtaataagaggcttgcgagcctcgatgagagtaccggacgaataag

SEQ ID NO: 5215 - DNA, 490 bp, Unknown
  Ascusbbf_1342375, encodes 16S rRNA
agagtttgatcctggctcaggatgaacgctagcggcaggcttaacacatgcaagtcgaggggcagcgcggggtagcaatacttctggcggcgaccagcggaagggtgcgtaacgcgtcagcaacatgcccgtcgcaggtggataatcgatggaaacgtcgtctaagaccccgtaacaacatacctcgcatgggttttgtttgaatgcttcggctaccacggattgactcgcatcctattggacagttggcgggggaacggcccaccaaaccgacgatgggtatgtgttctgagtggaaggtcccgagtgatggagctgagacacgtgccaaactcctacgggaggcagaagtgaggaatattgggcaatgggcggcagcctgaaccacccatgccgcgtgcaggaataaggccctacgggtcgtaaactgcttttgtacgggagcaataagggtcacgagtggcctgatgagagtaccgtacgaataagc

SEQ ID NO: 5216 - DNA, 490 bp, Unknown
  Ascusbbf_1372472, encodes 16S rRNA
agagtttgatcctggctcaggatgaacgctggcggcgtgcttaacacatgcaagtcgaacggagttatctcgctgaggagagcttgctcaaatcttgagctaacttagtggcggacgggtgagtaacgcgtggataacctgccttataccgggggataacacttagaaataggtgctaataccgcataagcgcacgctcccgcatgggaaagggtgaacaactccggtggtataagatggatcagcgtctgattagatagttggtgaggtaacggaccaccaagtcaacgatcagtagccggcctgagcggcggaacgaccacatggtgactgggacacggcccaaactcctacgggaggcagcagtggggaatattgcacaatgggtgaaacccggatgcagcgacgccgcgtgagtgaagaagtatgtcggtatgtaaagctctatcagcaaggaagaaaaaaatgacggtacttgactaagaagccc

SEQ ID NO: 5217 - DNA, 490 bp, Unknown
  Ascusbbf_1372577, encodes 16S rRNA
agagtttgatcctggctcaggataaacgctggcggcgcacataagacatgcaagtcgaacggaattaactcatagttaacgattgagagcggttagtggcggacgggtgagtaaggtataagaaacctgcgcatcagaggggaacaacagcgggaaacgactgctaataccgcatatgccacgagaataacatggtgcaagtgggaaaggagcaatccgctgatagatggacttatatctgattagctagtgggtggggtaacggccaaccaaggcgacgatcaggagccggacggagaggtaaaacggccaaactgggactgagatacggcccagactcctacgggaggcagcagtcgcgcatattgagcaatggcgcaaacgctaacgaagagacgccgcgttcaggcagaaggttttcggattgtaaactgctttagacaggtaagaaaaaagacagtacctgtagaataagctccggctaactacg

SEQ ID NO: 5218 - DNA, 490 bp, Unknown
  Ascusbbf_1324580, encodes 16S rRNA
agagtttgatcctggctcaggatgaacgctagcggcaggcttaacacatgcaagtcgaggggcagcgcgagagtagcaatacttttggcggcgaccggcggaagggtgagtaacgcgtgagcaacatgcccgtaacagggggataaccgttggaaacgacgactaatatcccgtaatatatcgagaggcatctcttgatattgaaagcttcggtggttacggattggctcgcgtctgattaggcagttggcggggtaacggcccaccaaaccgacgatcagtaggggttctgagaggaagggccaccaaatggggactgagacaaggtcacgaatcctacaggagggagcaggggggaatatttgacaaagggcggaaggctgatacagccatggcgggggaaggacgaagggcctatggggcggaaacatcttttgttgtggagcaataaggggtgcgagcagccccgatgagagtacacagcgaataa

SEQ ID NO: 5219 - DNA, 490 bp, Unknown
  Ascusbbf_1372551, encodes 16S rRNA
agagtttgacctggctcaggatgaacgctagctacaggattaacacaggcaagtcgaggggcagcagaacgaaagcttgcttttgttgatggcgaccggcgcacgggggaggaacgcgtagccaaccttccccttaggagggcagagcccggcgaaagtcggagtaataccctatgttttccgttgaggacatctgaagtggaacaaagagttatcgcgaagggagggggaggcgtctgattaggttgttggcgggggaacggcccaccaagccatcgatcagtaggggttctgagaggaaggtccccaaccttggtactgagccccggcccaaactcctacgcgaggcagccgtgcggcatattggtcaatgggcgcgagcctgacccagccacgtagcgtgcaggatgacggccctatgggttgtaacctgcttttgcatgggaataaagtgagggacgtgtccctttttgtatgtaccatgagaata

SEQ ID NO: 5220 - DNA, 470 bp, Unknown
  Ascusbbf_1324579, encodes 16S rRNA
agagtttgatcatggctcagaacgaacgctggcggaaggcttaacacatgcaagtcgaacgatcccttcggggatagtggcagacgggtgagtaacacgtgggaatctacctggttcttcgggataacagttggaaacgactgctaataccggatacgcccttttgggggcagctttatcggaatcgtatgagcccgcgtaagattagctagatggtggggtaatggcccaccatggcgacgatctttagctggtctgagaggctgctcagccacactgggactgagacacggcacagactccaacgtggggcagcaggggggagtattggacaatgggggcaaccctgagccagccatgccgcgtgagtgatgaaggccttagggttgtgaagctctttcagtagggaagataatgacggtacctacagaagaagccccggctaacttcgtgccagcagccgcggtaat

SEQ ID NO: 5221 - DNA, 490 bp, Unknown
  Ascusbbf_1372396, encodes 16S rRNA
agagtttgatcctggctcaggacgaacgctggcggcatgcttaacacatgcaagtcgaacggactgattccttcgggatgaaatttattggcgaacgggtgagtaatgtatgagcaacctgcctctatcaacgggataacagttggaaacgactgctaatactgtatatgaccacggcaccgcattatgctgcggtaaaatatttttctgatagatatgggctcatatcccatttgctatttgttgagataacagcccaccaaggcgacgcttggtagcctagctgggaggctgatcggccacattgggactgaaaaacggaccagacacctacgggaggcagcagtggggaatattgggcaatggaggcaactctgacccagcaatgccgcgtgagtgatgaaggtaattttattgtaaagctcttttctcaggaacgaataaagatgacggtacctgaggaataagccccggctaactacgtgccagc

SEQ ID NO: 5222 - DNA, 490 bp, Unknown
  Ascusbbf_1324586, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatatttttattctttcgcatgttaggataacgaaagcttcgttggttacggatggacgtgcgtgacattgggtaggtggtagggtaacggatagccaaggcgacgatgactaggtgggcggagaggcttatcacccacactggtactgagacacggaccagactcctacgggaggcagcagtgaggaatattggtcaatggacggaagtctgaaccagccaggtcgcgtggaggaagaaggtcctatgggttgtaaactccttttgttcgagagtaataagaggcttgcgagcctcgatgagagtatcggacgaataagc

SEQ ID NO: 5223 - DNA, 490 bp, Unknown
  Ascusbbf_1342239, encodes 16S rRNA
agagtttgatcctggctcaggacgaacgctggcggcatgcttaacacatgcaagtcgaacggactgattccttcgggttgaaagttagtggcgaacgggtgagtaatgtatgagcaacctgcctctatcaacgggataacagttggaaacgactgctcatacggtataagaccacggcaccgcatgatgctgcggtaaaagatttttcggatagagatgggctcatatcccattagctagttggtgagataaaagcccaccaaggcgacgatcggtagccgagctgagaggctgatcggcgccattggggctgagagacggcccagacacctacgggagacggcggaggggagtattgggcaatggaggcgacactgagccagcaatgccgcgtgagtgatgaaggtaattttatggtaaagcgcttttctcaggaacgaataaagatgacggtacctgaggaataagccccggctaactacgtgccagc

SEQ ID NO: 5224 - DNA, 490 bp, Unknown
  Ascusbbf_1372575, encodes 16S rRNA
agagtttgatcctggctcaggatgaacgctagctacaggcttagcacatgcaagtcgaggggcagcgagaaggaagctttctttctttgtcggcgaccggcgcacgggtgagtaacgcgtatccaaccttccctatagtagaggatagcccgtcgaaagtcggattaatactctatgttcttcgtagaggacatctgtaatgaagcaaagattaatcgctataggatggggatgcgtctgtttatgttgttggcggtgtaacggcccaccacaccatcgatcagtaggggtactgagagggaggtccccaccattggaactgagaaacggaccaaaagcctacggagggaagacgggaggaatattggtaaatgggcgagagcctgaaccagccaagtagcgggcaggatgacggccctaggggttgtaaactgcttttgcatgggaataaagtgagggacgtgtccctttttgtatgaaccatgagaat

SEQ ID NO: 5225 - DNA, 490 bp, Unknown
  Ascusbbf_1372531, encodes 16S rRNA
agagtttgatcctggctcaggatgaacgctagcggcaggcttaacacatgcaagtcgaggggcagcgcggggtttccttactctctctgctaccgtccgacgggtgcgtaacgcgtgcgcatcatgcccttggcttggtgataagcgatgcgaacgtcgtctcagacctcgtcacaacactcctcgcatggggtttgtttgaaagcttcggctgccccggattggctcgcgtcccattaggaagttgggtgggtaacggcccaccagaccgacgcggcgtaggggttctgagaggaaggtccccaacaatggacgtgagacacggtccaaacgcctacgggaggaagaagtgaggaatattgggcaatgggcgagagactgaaccagccaggcagcgtgcaggatgaaggccctacgggtcgtaaactgcttttgtacgggagcaataaggggcacgagtggccggatgagagtaccgtacgaataagca

SEQ ID NO: 5226 - DNA, 490 bp, Unknown
  Ascusbbf_1324427, encodes 16S rRNA
agagtttgatcctggctcaggatgaacgctggcggcgtgcttaacacatgcaagtcgaacggaaaggtttcttcggaattctttcagtggcggacgggtgagtaacgcgtgggtcagctgccccatacagggtaacaacagctggaaacggctgctaataccgcataaccgcacagtgctgcatggtaccgtgtgaaaagattttatcggtatgggatggaccctcgtctgattagctagttgggggggtaacggcgcacaacggcgacgctcagtagcagacctgagagggtgagcggccacattgggacggagacacggaccaaactcctacgggaggcagcagtggggtatatggcacaatgggcgaaagcctgatgcagcgacgccgcgtgagcgaggaagtatttcggtatgtaaagctctatcagcagggaagataatgacggtacctgactaagaagcaccggctaaatacgtgccagcagcc

SEQ ID NO: 5227 - DNA, 490 bp, Unknown
  Ascusbbf_1435438, encodes 16S rRNA
agagtttgatcatggctcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaaagtcggattaataccctatgttttccgttgaggacatctgaagtggaataaagatttatcgctaagggatggggatgcgtctgattaggttgttggcggggtaacggcccaccaagccatcaatcagtaggggttctgagaggaagatccaacacaatggtactgagaaacggagaaaaatactcggggaggcaacagtgcggaaaagtggtcagtgggcgggagcctgaaccagcaaagaagcgtgcaggatgacggccctatgggttgtagactgcttttgcatgggaataaagtgagggacgtgtccctttttgtatgtaccatgagaat

SEQ ID NO: 5228 - DNA, 490 bp, Unknown
  Ascusbbf_1372552, encodes 16S rRNA
agagtttgatcctggctcaggatgaacgctggcggcgtgcctaacacatgcaagtcgaacggaaaggattcgtcggaattctttcagtggcggacggaggaggaacgcgtgggtaaccggccccatacaggggaacaacagctggaaacggcggcgaataccgcataagcgcacagtactgcatggtacagtgtgaaaagattttatcggtatgggatgaacccgcgtctgattagctagttggaggggtagcggcccaccaaggcgacgatcagtagccgacctgagagggtgaccggcccaattgggactgagccacggcacacactcctacgggaggcagcagtgggggatattgcacaatgggcgaaagcctgatgcagcgacgccgcgtgagtgaggaagtttttcggtatgtaacgctctatcagcagggaagaaaatgacggttcctgactaagaagccccggctaactacgtgccagcagcc

SEQ ID NO: 5229 - DNA, 490 bp, Unknown
  Ascusbbf_1372529, encodes 16S rRNA
agagtttgatcatggctcaggatgaacgctggcggcgtgcctaatacatgcaagtcgaacgaggtttcccttcggggaaaccgagtggcgaacgggtgagtaacacataggtaatctacctttcagaatgggatacccaagagaaattttggctaataccgtatacaatcatttctccgcatggagatttgatgaaaggggctccaaagcctcgctgttagatgaacctgtggcacattagctagttggtgagataacagcccaccaaggcgaaggtgtgtagccgatctgagaggataatcggccacaatgggacggggatacggcccaaactacaacgggaggcagaagtagagaggtgtcggcaaggggggaaacgctgaccgggcaacgccgcgtgatgtagaaggccctctgggtcggaagaatctgttgtaaaggagagagggtagtgggaggaaatgcccattatttgatagtacttgattag

SEQ ID NO: 5230 - DNA, 490 bp, Unknown
  Ascusbbf_1324595, encodes 16S rRNA
agagtttgatcctggctcaggatgaacgctagcggcaggcttaacacatgcaagtcgaggggtaacgcggggtagcactactctgtcgactaccggcgcacgggtgcgtaccgcgtatgcaacctacctgtaacagggttataacggagagaaatttccactaatcccccatattgttagagattcgcatgtttctctaacgaaagcttcggtggttactgatgggcatgcgtgacattagctatttggtaaggtaacggcttaccaaggcgacgatgtctatgggagctgagaggcttatcaccacaactggtactgagacacggaccagactcctacgggaggcagcagtgaggaatattggtcaatggacggaagtctgaaccagccaggccgcgtggaggaagaaggtcctatgggtggtaaactccttttgtgcgagagtaataagaggcgtgcgagcctagatgagagtatcggacgaataagc

SEQ ID NO: 5231 - DNA, 490 bp, Unknown
  Ascusbbf_1325123, encodes 16S rRNA
agagtttgatcctggctcaggacgaacgctggcggcatgcttaacacatgcaagtcgaacggactgattccttcgggatgaaagttattgtcgaacgggtgagtaatgtatgagcaacctgcctctctccacgggataacagttggaaacgactgctaatacggtgtaagaccacggcaccgcatggtgctgcggtaaaagatttttcagacagagatgggctcatatcccattagctagttggtgagataatagcccaccaaggcgacgatgggtagccgagctgagagccggatcggcgacactggggctgaaacacggaccagagacctacgggagggagaagtggggaatattgggcaatggaggaaactctgacccagcaatgccgcgtgagcgataaagggaattttattgtaaagctcttttctcaggaacgaataaagatgacggtacctgaggaataagcaccggctaactacgtgccagc

SEQ ID NO: 5232 - DNA, 490 bp, Unknown
  Ascusbbf_1341693, encodes 16S rRNA
agagtttgatcatggctcaggatgaacgctggcggcgtgcctaacacatgcaagtcgaacggaaaggattcttcggaattctttcagtggcggacgggtgcgtaacgcgtgggtaacctgccccatacaggggaacaacagctggaaacggctgctaataccgcataatcgcacagttctgcatggtacagtgtgaaaagattttgtcggtatgggatggatccgcgtctgattagctagttggagcggtaacggcccaccaagccgacgatcagtaggcgacctgagagggtgaccggcaacattgggactgagacaccgcccaaactcctacgggaggcagcagtgggggatcttgcaccataggcgggagcctgatgcagcgacgcagcgggagtgaggaagtatttcggtatgtaaagctctatcagcagggaagaaaatgacggtacctgactaagaagccccggctaactacgtgccagcaccg

SEQ ID NO: 5233 - DNA, 486 bp, Unknown
  Ascusbbf_1341707, encodes 16S rRNA
agagtttgatcctggctcagaacgaacgctggcggcaggtcttaggcatgcaagtcgaacggacgacagagtggcttgccattctgaagttagtggcgcacgagtgagtaacgcgtgggaaactgcccttcactggggaataacgtctggatacggacgctaataccgcatacgcccgcaaggggaaagatttatcggtgttgatggtgcctgggttggatgagcttgttgttggggaaatggcctaccaaggcgatggtccatagctgggctgagaggacgatcagccacgcgggaactgagacagggtccagactccgacggggggcagcagctaagaatattgggaaatggaagaaactctgacccagccatgccgcgtgaatgaagaaggccttcgggttgtaaagttcttttagtcatgaagatgatgacagtagtgacagaaaaagcaccggctaacttcgtgccagcagccgcggtaat

SEQ ID NO: 5234 - DNA, 486 bp, Unknown
  Ascusbbf_1377813, encodes 16S rRNA
agagtttgatcctggctcaggatgaacgctagctacaggcttaacacatgcaagtcgaacggacgacagagtggcttgccattctgaagttagtggcgcacgagtgagtaacgcgtgggaaactgcccttcactggggaataacgtctggaaacggacgctaataccgcatacgcccgcaaggggaaagatttatcggtcacggatgtgcccgcgttggattagcttgttggtggggtaatggcctaccaaggcgatgatccatagctggtctgagaggacgaacagccacgctggaactgagacacggaccagactcctacgtggggcagcagctaagaatactgagcaatggaggaaactctgacccagccatgccgcgggaatgaagaaggccttcgggttgtaaaaagcttttagtcatgaagatgatgacagtagtgacagaaaaagcaccggctgacttcgtgccagcagccgcggtaat

SEQ ID NO: 5235 - DNA, 486 bp, Unknown
  Ascusbbf_1324996, encodes 16S rRNA
agagtttgatcctggctcaggatgaacgctagctacaggcttaacacatgcaagtcgaacggacgacagagtggcttgccattctgaagttagtggcgcacgagtgagtaacgcgtgggaaactgctcttcactggggcataacgtctggaaacggacgctaataccgcttacgcccgccaggggatggacttatcggtgacggatgtgcccgctttggattagcttgttggtggcgtaatggcctaccagggcgatgatccatagctggtctgagaggacgatcagccacgacggaaatgagacacggtccagactccaacgggaggcagcagctaagaatattgggcaatggaggaaactctgacccagccatgccgcgtgaatgaagaaggccttcgggttgtaaaaatcttttagtcatgaagatgatgacagtagtgacagaaaaagcaccggctgacttcgtgccagcagccgcggtaat

SEQ ID NO: 5236 - DNA, 486 bp, Unknown
  Ascusbbf_1377631, encodes 16S rRNA
agagtttgatcatggctcagaacgaacgctggcggcaggtcttaggcatgcaagtcgaacggacgacagagtggcttgccattcttcagttagtggcgcacgagtgagtaacgcgtgggaaactgcccttcactggggaataacgtctggaaacggacgctaataccgcatacgcccgcacggggaaagatttatcggtggtggatgttcccgcgttggcttcgcttgttggtggggtattggcctacccaagcgatgatccttagctggtctgggaggacgctcagcaacgctggaactgagaaacggtccagactcctacgggaggcagcagctaagaatatcgggcaatggaggaaactctgaaccagccatgccgcgtgaatgaagaaggccttcgggttgtaaagttcttttagtcatgaagatgatgacagtagtgacagaaaaagcaccggctaacttcgtgccagcagccgcggtaat

SEQ ID NO: 5237 - DNA, 486 bp, Unknown
  Ascusbbf_1341662, encodes 16S rRNA
agagtttgatcatggctcagaacgaacgctggcggcaggtcttaggcatgcaagtcgaacggacgacagagtggcttgccattcttcagttagtggcgcacgagtgagtaacgcgtgggaaactgcccttcactggggcataacgtctggaaacggacgctaatccctcatacgcccgcacgggtaaagatttatcggttatggattttcccgcgttggagtagctggttggtgggttaatggcctcccaatgcgatgatccatagctggtcttagaggccgatcagccacgcgggaactgagacacggtccagactccgacgggaggcagcagctaagaatattgggcaatggaggaaactctgacccagccatgccgcgtgaatgaagaaggccttcgggttgtaaagttctttgaggcatgaagatgatgacagtagtgacagaaaaagcaccggctaacttcgtgccagcagccgcggtaat

SEQ ID NO: 5238 - DNA, 490 bp, Unknown
  Ascusbbf_1377667, encodes 16S rRNA
agagtttgatcatggctcaggatgaacgctagcggcaggcttaacacatgcaagtcgaggggtaacgcggggtagccctcctctttctactaccggcgcacgggtgcgtaacgcgtatgcaacctacctgtcccaggggtataacggagagaaatttccactaatcccccctcttgttatagattcgcatgtttctctaacgaacgcttcgttgcttacggatgggcatgcgtgacattcgctagttggtaaggtaacggcttaccaaggcgacgatgtctaggggtggtgagaggcttatcccccacactgggactgcgacacggaccagactcctacgggaggaagcagtgaggaaaatggggcaatggacgggagactgaaccagccatgcagcgtggaggaagaaggtcctatgggttgtaaactccttttgttcgagagtaataagaggctggcgagcctcgatgagagtatcggacgaataagc

SEQ ID NO: 5239 - DNA, 490 bp, Unknown
  Ascusbbf_1325067, encodes 16S rRNA
agagtttgatcatggctcaggatgaacgctagcggcaggcttaacacatgcaagtcgaggggtaacgcggggtagcaatcctctgtcgacgaccggcgcacgggtgcgtaacgcgtatgcaacctacctgtaacaggggtataacggagagaaatttccactaatcccccatattgttattctttcgcctgttcggataccgaaagcttcgttggttacggatgggcatgcgtgccattagctagttggtaaggtaacggcttaccacggcgactctgtctatgggagctgagaggcttataccccagacgggtacagcgcaacagaccagaaccctacgcaaggaagcagggaggagtattggtcaatggacggaagtctgaaccagccatgccgcgtggaggaagaagggcctatgggtggtaaactccttttgtgcgagagtaataagaggcttgcgagcctcgatgagagtatcggacgaataagc

SEQ ID NO: 5240 - DNA, 470 bp, Unknown
  Ascusbbf_1324981, encodes 16S rRNA
agagtttgatcctggctcagaacgaacgctggcggcaggcttaacacatgcaagtcgagcgcactcttcggagtgatcggcattcgggtgagtaacacgtggggatctaccaatctctaggcaataattcactgaaacttgtgctactaccctatacgcccttttgtggaaagatttatcggagtttgacgagcccgcgtgggattagctagttggtgatttaagagctcaccaaggcgacgatccctagctggtatgaggggttgatccgctacactgggactgagacacggcccagactcttagggaagggagcagtggggaatatgggacgaggcgcgcaagacggagccagccaggccgcaagggtgatgaaggccggacggatgtaaagcactttcaccgatgaagataatgacggtagtcggagaaaaagccccagctaactatgtgccagcagccgcggtaat

SEQ ID NO: 5241 - DNA, 490 bp, Unknown
  Ascusbbf_1445465, encodes 16S rRNA
agagtttgatcctggctcaggacgaacgctggcggcgtgcctaacacatgcaagtcgaacggaacttatttagaagattttttcgggatgattttgattaagtttagtggcggacgggtgagtaacgcgtgagtaacctgcctttgagaggggaataacaatctgaaaagattgctaataccgcataacatatatttgtcgcatggcagatatatcaaagattttatcgctcaaagatggactcgcgtccgattagttagttggtgaggtaacggctcaccaagaccgcgatcggtagccgaacgggagcaggacgggagggttgaccggacacattgggactgagaaacggcccagcatcctacgggaggcagaagtgggaggtattgcgcaatgggggaaacccggacgcagcaacgccgcgtgaagaatgaaggttttcggattgtaaacttcttttattagggacgaaaaatgacggtacttaatg

SEQ ID NO: 5242 - DNA, 486 bp, Unknown
  Ascusbbf_1341792, encodes 16S rRNA
agagtttgatcatggctcagaacgaacgctggcggcaggccttaggcatgcaagtcgaacggacgacagagtggcttgccattctgaagttagtggcgcacgagtgagtaacgcgtgggcaactgcccttcactggggaataacgtctggcaacggacgctaataccgcatacgcccgcaaggggaaagatgtgtcggtgatggatgtgcccgcgttggattagcttgttggtggggtactggcctaccaaggcgatgatcaatagctggtctgagtgaacgatcagccacgctggaactgagacacggtccagactcctacggggggcaagaggtaagaatatcgggcaatggaggaaactctgacccagccatgccgcgtgaatgaagaaggccttcggggtgtaaagttcttttagtcatgaagatgatgacagtagtgacagaaaaagcaccggctaacttcgtgccagcagccgcggtaat

SEQ ID NO: 5243 - DNA, 490 bp, Unknown
  Ascusbbf_1377848, encodes 16S rRNA
agagtttgatcctggctcaggatgaacgctggcggcgtgcctaacacatgcaagtcgaacggaaacaattcttcggaattctttcagtggcggacgggtgagtaactcgtggttaacctgccccatacatgggaacaacagctggaaacggctgctaataccgcctaagcgcacagtactgcatggtacagtgtgaaaagactttatcggtatgggaggtatccgcgacggattagctagttgcagtggtaacggcccaccaaggcaacgatcagtagccgacctaggagggtgccgggcaccattgggcctgagcaacggcacaaagtccaacgtggggcagcagtcgggaatattgaacaatggactaaagcctgaggcagcggcgccgcgtgggtgaggaagtatttcggtatgtaaagctctatcagcagggcagaaaatgacggtacctgactaagaagccccggctaactacgtgccagcagcc

SEQ ID NO: 5244 - DNA, 490 bp, Unknown
  Ascusbbf_1377840, encodes 16S rRNA
agagtttgatcctggctcaggacgaacgctggcggcgtgcttcatacatgcaagtcgaacgagaaactaacttcggttagtggaaagtggctgacgggtgagtaatatgtagataatctgccctagagagggggacaaccgttggaaacgacagctaataccccatatgagcgtaactgaaatgttattcttgaaaactccggtgctctaggatgagtctgcatctgattagctagttggggtggtaattgaccaccaaggccacgatcagtagctggtttgagaggatgatcagccaccaagagactgagacacgggccaaaatcctacgggaggcagcagtagggaattttgcgcaatgggcgaaagcctgacgcagcaacgccgcgtgatcgagacgcttttcggagtgtaaagatctgtcacaggggacgaacaatgacggtaccctgagaggaagcaccggctaactccgtgccagcagccgcgg

SEQ ID NO: 5245 - DNA, 470 bp, Unknown
  Ascusbbf_1445496, encodes 16S rRNA
agagtttgatcatggctcagaacgaacgctggcggcaggcttaacacatgcaagtcgagcgccctcttcggagggagcggcagactggtgagtaacacgtgggaatctacccatctctagggaataactcagggaaacttgtgctaataccctatacgcccttcgggggaaagatttttctgaggtggataagcccgcgttggattagctagttggtggggtaatggctcaccaaggcgactatccatagctggtctgagaggatgatcagccacactgggactgagacacggcccagactccgacgggaggcagcagtggggaagattggacaatgggcgaaagccggatccagccatgccgcgtgtgtgatgaaggccttagggttgtaaagcactttcaccgatgaagataatggcggtagtcggagaagaagccccggctaacttcgtgccagcagccgcggtaat

SEQ ID NO: 5246 - DNA, 490 bp, Unknown
  Ascusbbf_1445687, encodes 16S rRNA
agagtttgatcctggctcaggatgaacgctagctacaggcttaacacatgcaagtcgaggggcagcataacgaaagctggcttttgttgatggcgaccggcgcacgggggagtaacgcgtatccaaccttccccgtagtagggcagagcccggcgaaagtcggatgaataccctatgttttccgttgaggacatcttaagtggaaccaagatttatcgctaagggatggggatgcgtctgattaggttgttggcggggtaacggcacaccaagccatcgtgaagaaggggttctgagaggaaggtccaccaacgtggtactgagacacggaacaaactcctacgggaggcagccgtgaggaatattgggcaatgggcgagagcctgaaccagccaagtagcgtgcaggatgacggccctatgggttgtaaactgcttttgcatgggaataaagtgagggacgtgtccctttttgtatgtaccatgagaat

SEQ ID NO: 5247 - DNA, 488 bp, Unknown
  Ascusbbf_1445624, encodes 16S rRNA
agagtttgatcctggctcagaacgaacgctggcggcaggcttaacacatgcaagtcgagcgggattgattagtagcttgctttttatcatgagagcagcgcactggtgagtaacacgtgggtacataccttttggtgggggacaacagttggaaacgactgctaataccgcatcagctctgaggtggaaagattaattgccgtggaattggcccgcggaagtttaggtagtaggtggggtaacggcctacctagccgacgatctatagctggtctgagaggacgatcagccacattggaagtgagacacggaccagactcctacggggggcaacagtggggaatattgagcaatggaggaaactcagacccagccatgccgcgtgggtgaagaaggttttcggaggggaaagcgctttcagacgggaagatgatgacggtaccgtaagaagaagcaccggctaacttcgtgccagcagccgcggtaat

SEQ ID NO: 5248 - DNA, 486 bp, Unknown
  Ascusbbf_1377729, encodes 16S rRNA
agagtttgatcatggctcagaacgaacgctggcggcaggtcttaggcatgcaagtcgaacggccgaccgagtggcttgccattctgcagttagtggcgcacgagtgcgtaacgcgtgggcaactgcccttcactggggcataacgtctggaaacggacgctaataccgcatccgcccgcaaggggaaagatttatcggtgatggatgtgcccgcgttggtttcgcttgttggtggggtaatggcctcccaaggcggttgtccatagctggtctgagaggacgttcagccacgctggaactgggacacggtccagactcctacgggaggcagcagctaagaatattgggcaatggaggaaactctgacccagccatgccgcgtgaatgaagaaggccttcgggttgtaaagttcttttagtcatgaagatgatgacagtagtgacagaaaaagcaccggctaacttcgtgccagcagccgcggtaat

SEQ ID NO: 5249 - DNA, 486 bp, Unknown
  Ascusbbf_1325055, encodes 16S rRNA
agagtttgatcatggctcagaacgaacgctggcggcaggtcttaggcatgcaagtcgaacggacgacagagtggctttccattctgaagttagtggcgcacgagtgcgtaacgcgtgtgcaactgcccttcactggggcataacgtctggacacggacgctaataccgcatacgcccgcaaggggaagggtttatcggtgttggatgtgcccgcgttggattagcttgttggtggggtaatggcctaccaaggcggtgatccatcgctggtctgagaggacgatcagccacgctggaactgagacacggtccagaatcctacgggaggcagcagctaagaatattgggcaatggaggaaacgcggacccagccatgccgcgtgaatgaagaaggccttcgggttgtaaagtgcttttagtcatgaagatgatgacagtagtgacagaaaaagcaccggctaacttcgtgccagcagccgcggtaat

SEQ ID NO: 5250 - DNA, 490 bp, Unknown
  Ascusbbf_1323765, encodes 16S rRNA
agagtttgatcctggctcaggatgaacgctagcggcaggcctaacacatgcaagtcgaggggtagaacacttcggtgtttgagaccggcgcacgggtgcgtaacgcgtatgcaatctaccttatacaggggaatagcccagagaaatttggattaatgccccatggtattatagagtggcatcactttataattaaagttccaacggtataagatgagcatgcgtcccattagttagttggtaaggtaacggcttaccaagacgatgatgggtaggggtcctgagagggagatcccccacactggaactgggacacggaccagactcctacgggaggcagcagtgaggaatattggtcaatggtcgcaagactgaaccagccatgccgcgtgcaggaagacggtcctatggattgtaaactgcttttatacaggaagaaaccctcccacgtgtgggagcttgacggtactgtaggaataaggatcggcta

SEQ ID NO: 5251 - DNA, 490 bp, Unknown
  Ascusbbf_1325027, encodes 16S rRNA
agagtttgatcatggctcagaacgaacgctggcggcaggcttaacacatgcaagtgggacgggaagcgagggatagctggctattgattgaggagaggaacgcacgggtgagtaacacgtgggaacataccggatagggggggagaacaagtggaaacgattgataataccgcataagtcctaagggagaaaggagcaattcgctataagattggcccgcggaagattaggcaggtggtggggtaaaggcctaccaaacctacgatctatagctggtctgagaggacgatcagccacattgggactgcgacacggccccgactcctacggggggcagcagtgcggcatattgggcactgggggcaaccctgacccagccctgccgcgtgagtgaagaaggttttcgaattgtaaagctctttcggatgtgaagatgatgacggtagcatctcaagacgccccggcaaacttcgtgccagcagccgcggta

SEQ ID NO: 5252 - DNA, 288 bp, Unknown
  Ascusbbf_1325038, encodes 16S rRNA
agagtttgatcctggctcaggatgaacgctagcggcaggcttaacgcatgcaagtcgaggggtaacgcgaggtaacaatactctggctactaccggcgcacggccgcgtaacgcgtgtggaacctccctgtcacgggggtattgcggaccgatgtttccactgatcccccatattgttgttctttcgcatgttaggataacgaaagcaagaatgggggcgggggggcaagcgtggcgttagctagttggtgagggaacggcgaaccaaggccacgaagtcgaggggag

SEQ ID NO: 5253 - DNA, 490 bp, Unknown
  Ascusbbf_1325012, encodes 16S rRNA
agagtttgatcctggctcaggatgaacgctggcggcgtgcttaacacatgcaagtcgaacggagttatctcgctgaggagagcttgctcaaatcttgagatgacttagtggcggacgggtgagtaacgcgtggataacctgccttataccgtgggataacacttagaaataggtgctaataccgcataagcgcacgatcccgcatgggaaagtgtgaaaaactccggtggtataagatggatccgcgtgtgatgagatagttggtgaggtaacggcccaccaagtcaacgctcagtagccgacctgggaggggtgacggccacattgggaattagacacggccccaactcctacgggaggtagcagtggggaatattgcacaatggggggaaccctgatgcagcgaagccgcgtgagtgaagaagtatctcggtatgtaaagctctatcagcaaggaagaaaaaaatgacggtacctgactaagaagccc

SEQ ID NO: 5254 - DNA, 486 bp, Unknown
  Ascusbbf_1445679, encodes 16S rRNA
agagtttgatcatggctcagaacgaacgctggcggcaggcctcaggcatgcaagtcgaacggtcgccagagtggctttccattctgttgttagcggcgcacgagcgagtaacgcgtgggtaactgcccttcactggggtataacgtctggaaacggacgccaacaccgcatacgcccgcaaggggacagacttaccggtgctggaggtgccggcgtgggattagcctgttggtggggtaattgccgcccaaggcgaggatccatagctggtctgggaggacgatcagccacgctgggactgagacacggtccagggtcctacggggggcagcagctgagaatattaggcactggaggaaactctgacccagccatgccgcgtgaatgaagaaggccttcgggttgtaaagttcttttagtcatgaagatgatgacagtagtgacagaacaagcaccggctaacttcgtgccagcagccgcggtaat

SEQ ID NO: 5255 - DNA, 490 bp, Unknown
  Ascusbbf_1445686, encodes 16S rRNA
agagtttgatcatggctcaggataaacgctggcggctcacataagacatgcaagtcgaacgaacttaatcgaaagtgtacttttgaagcggttagtggcggactggtgagtaactcgtaagcaatctgcctatcagaggggaataacagtgagaaatcattgctaataccgcataagctgtgagtatcgcatgatacaaatagaaaaggagcaatccgctgatagatgagcttgcttctgattagttagttggtggggtaacggcccaccaagacgatgatcagtagccggactgagagggtaaacggccacattgggacggcgatacggcccagaaccgtccgggagggagcagtcgggactattgcgcaatggaggacactctgacgcagtgacgccgcgtgcaggaagaaggttttcggattgtaaactgatttagatagggaagaaaaaaatgacggtacctatagaataagctccggctaactac

SEQ ID NO: 5256 - DNA, 488 bp, Unknown
  Ascusbbf_1341767, encodes 16S rRNA
agagtttgatcatggctcagaacgaacgctggcggcaggcttaacacatgcaagttgagcgggattgattgatagcttgctattgctcatgagagcagcgcactggtgagtaacacgtgggaacataccttttggtgggggacaacagttggaaacgactgctactaccgcctcagccctgagggggaaagattaattgccgagagattggcccacggaagattaggtagtaggtggggtaacggcctacctacccgacgatctatagctggtctgagaggacgatcagccacattggaacggggacacggtccagaagcgaacggggggcaacagagaggagtattaggcaatggagggaactcggagccagccacgccgcgtgagggaagaaggttttcggagggtaaagcgcttgcagacgggaagatgatgacggtaccgtaagaagaagcaccggctaacttcgtgccagcagccgcggtaat

SEQ ID NO: 5257 - DNA, 488 bp, Unknown
  Ascusbbf_1377735, encodes 16S rRNA
agagtttgatcatggctcagaacgaacgctggcggcaggcttaacacatgcaagttgagcgggattgtttgatagcttgctattgatcatgagagcagcgcactggtgagtaacacgtgggaacataccttttggtgggggacaacagttggaaacgactgctaataccgcataagccctgagggggaaaggttaattgccgagagattggcccacgggagattaggtagtaggtggggtaacggcctacctagccgacgatctatcgctggtctgagaggacgatcagccacattggaacggagagacggtccagagtcgtacgggaggcaacggggaggaatattgggcaatggagggaactctgagccagccatgccgcgtgagggaagaaggttttcggagtgtaaagcgcgagcagacgggaagatgatgacggtaccgtaagaagaagcaccggctaacttcgtgccagcagccgcggtaat

SEQ ID NO: 5258 - DNA, 488 bp, Unknown
  Ascusbbf_1342406, encodes 16S rRNA
agagtttgatcatggctcagaacgaacgctggcggcaggcttaacacatgcaagttgagcgggattgattagtagcttgctattgatcatgagagcagcgcactggtgagtaacacgtgggaacataccttttggtgggggacaacagttggaaacgactgctaataccgcataagccctgagggggaaagattaattgccaaaaggttggcccgcggaagattaggtagtaggtgggttaacggcctacctagccgacgatcgatagctggtctgagaggacgatcagccacattggaactgcgacagggtccagagtcgtacggggggcagcagtggggaatattgggcaacggaggcacctctgaccaagccacgccgcgtgagtgaagaaggttttcggatggtaaagctctttcagacgggaagatgatgccggtaccgtaagaagaagcaccggctaacttcgtgccagcagccgcggtaat

SEQ ID NO: 5259 - DNA, 486 bp, Unknown
  Ascusbbf_1372630, encodes 16S rRNA
agagtttgatcatggctcagaacgaacgctggcggcaggtcttaggcatgcaagtcgaacggacgacagagtggcgtgccattctgaaggtaggggcgcacgagggagtaacgcgtgggaaccggcccttcactggggaagaacgtcgggaaacggacgctaataccgcatacgcccgcaaggggcacgagttatcggtgatggatgtgcccgcgttggattagcttgttgttggggtaatggcctaccaaggcgatgatccatagctggtctgagaggacgatcagccacgctggaactgagacacggtccagactcctacggggggctgcagctaagaatattgggcaatggaggaaactctgacccagccatgccgcgtgaatgaagaaggccttcgggttgtaaagttcttttagtcatgaagatgatgacagtagtgacagaaaaagcaccgtctaacttcgtggcagcagccgcggtaat

SEQ ID NO: 5260 - DNA, 490 bp, Unknown
  Ascusbbf_1435325, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggcgagaaatttccactaataccccatattgttattctttcgcatgttaggataacgacagcttcggtggttacggatggggatgcgtgacattagctagtgggtaaggtaacggcttaccaaggcgacgatgtctaggggagctgagaggcttatcgcccacgctggtagtgagacacggatcagactactacgggaggcagcagcaaggaagagtgggcaatggggagaagtgtgaaccagacgagcctcgtgggggaagaaggtgctagtggtaggaaactccttgtgttggagagtaataagaggcgggcgagccacgaggagagtatcggacgaataggc

SEQ ID NO: 5261 - DNA, 490 bp, Unknown
  Ascusbbf_1372598, encodes 16S rRNA
agagtttgatcctggctcaggataaacgctggcggcgcacataagacatgcaagtcgaacgaacttaatcgaaagtttacttttgaagcggttagtggcggactggtgagtaacgcgtaagcaatctgcctatcagaggggaataacagtgagaaatcatttctaataccgcctaagctgtgagtatcgcatgatacaaatagaaaagtagcaatccgctgatagatgagctggcgtctgattagttagtgggtggggtaacggcctaccaagacgatgatcagtagccggactgagaggttaatcggcaacatagggactgagataaggcccaaactcctacgggaggcagcagtagggaatattgcgaaatggaggaaactcggacgacgtggagacgcgtgcaggaagaaggttttcggattgtaaactgctttagatagggaagagaaaaatgacggtacctatagaataagctccggctaactac

SEQ ID NO: 5262 - DNA, 415 bp, Unknown
  Ascusbbf_1325171, encodes 16S rRNA
agagtttgatcctggctcaggataaacgttggcggcgcacataagacatgccagtcgaacgaacttaatcgaaagtttacttttgaagcggttagtggcggactggtgagtaacgcgtaagcaatctgcctatcagaggggaataacagtgagaaatcattgctaataccgcataagctgtgagtatcgcatgatacaaatagaaaaggagcaatccgctgatagatgagtacgcgtctgattagttcgttggtgaggtgacgggaatatagcgcaatggagggtacccggacgcagtgacgccgcgtgcaggaagaaggttttcggattgtaaactgctttagatagggaagaaaaaaatgacggtacctatagaataagctccggctaactacgtgccagcagccgcggtaat

SEQ ID NO: 5263 - DNA, 488 bp, Unknown
  Ascusbbf_1372622, encodes 16S rRNA
agagtttgatcctggctcagaacgaacgctggcggcaggcttaacacatgcaagttgagcgggattaattgatagcttgctattaattatgagagcagcgcactggtgagtaacacgtgggaacataccttttggtgggggacaacagttggaaacgactgctaataccgcataagccctaagggggaaagattaattgccgaaagattggcccgcggaagattaggtagtaggtggggtaacggcctacctagccgacgatctatagctggtctgagaggacgatcagcctcattggaacctgggcaccggtcagggtcctaccggggggagtagtggagaaattttggcaatgaaggcaactctgacccagccatgccgcgtgagtgaagaaggttttcggattgtaaagctctttcagacgggaagatgatgacggtaccgtcagaagaagcaccggctaacttcgtgtcagcagccgcggtaat

SEQ ID NO: 5264 - DNA, 353 bp, Unknown
  Ascusbbf_1325310, encodes 16S rRNA
agagtttgatcctggctcaggatgaacgctggcggcgtgcctaacacatgcaagtcgaacgaagcaccttttcacgatcccttcggggtgacgagattgtgacttagtggcggacgggtgagtaacgcgtggggaacccgccctgtactgggggatagcgactggcaacggtcgttactaccgcataagcgcaggccataacatggtgaagtgtgcaatggtcgaatgctagatgatgcgaccgcgtctgagtggcgaagtatttcggtatgtaaagccctatcagcagggaagaaattgacggtacctgactaagaagctccggttaaatacgtgccagcagccgcggtaat

SEQ ID NO: 5265 - DNA, 490 bp, Unknown
  Ascusbbf_1325155, encodes 16S rRNA
agagtttgatcctggctcagaacgaacgctggcggcaggcttaacacatgcaagttggacgggaatcgattgatagcttgctattgattgaggagagtagcgcacgggtgagtaacacgtgggaacataccttatagtgggggataacaattggaaacgattgataataccccataagtcctattggagaaagaagcaattcgctctacgattggcccgcggaagattaggcggttgttggggtaaaggcctaccaaacctacggtctatagctggtatgagaggacgatcagccacatttggactacgagacggcccagacaccaacgggaggcagcagtgaggagtattaggcaatgggggcaaccctgacccagccatgccgcgtgagtgaagaaggttttcgaattgtaaagctctgtcggatgtgaagatgatgacggtagcatctaaagaagccccggcaaacgtcgtgccagcagccgcggta

SEQ ID NO: 5266 - DNA, 490 bp, Unknown
  Ascusbbf_1325311, encodes 16S rRNA
agagtttgatcctggctcaggataaacgctggcggcgcacataagacatgcaagtcgaacggacttaactcattcttaacgattgagagcggttagtggcggactggtgagtaatgtataagtaacctgcctatcagaggggaacaaccgctggaaacgactgctaataccgcatatgccacgagaatcacatggttcaagtgggaaaggagcaatccgctgatagatggacttatatgtgattagctagttggtggggtaacggcctaccaaggggacgaacagtagccggactgggaggttaaacagcgacaaagggactgcggtacggcgcagagtccaacgggaggcagcggtcgggaatattacgcaatggaggaaactctgacgcagtgacgccgcgtgcaggaagaaggttttcggattgtaaactgctttagacagggaagaaaaaagacagtacctgtagaataagctccggctaactacg

SEQ ID NO: 5267 - DNA, 490 bp, Unknown
  Ascusbbf_1342493, encodes 16S rRNA
agagtttgatcatggctcaggacgaacgctggcggcgtgcctaacacatgcaagtcgaacgaggtccatgcagtggcaacactgcggaagacctagtggcgaacgggtgagtaacccgtgaggaacctgccccgaagaccgggataaccctccgaaaggagagctaataccggatacccccatcaggtggcatgatttgatgaggaaatggattccgcttcgggagggcctcggggcatatcatctagtgggtgggggaacggcctaccaaggcattgactggtggctggtctgagaggtggatcggcaaaactgggactggaaaccgccccagattcctccggagggaagcagaggggaatctggcgcaatgggcgaaagcctgaggcagcaacgccgcgggggggatgaaggctttcgggttgtaaacccctttcagcagggacgaatcaagacggtacctgcagaagaagccccggctaactacgtg

SEQ ID NO: 5268 - DNA, 486 bp, Unknown
  Ascusbbf_1325116, encodes 16S rRNA
agagtttgatcctggctcagaacgaacgctggcggcaggtcttaggcatgcaagtcgaacggacgccagagtggcttgccattctgaagctagtggcgcacgagtgagtaacgcgtgggaaactgcccttcactggggaataacccctggaaacggacgctaataacccatacgcccgcaaggggaaagatttatcgctgatggatgtccccgcgttggattggagtgttagtcgggtaatggcctacccaggcgatgaaccatagctggcatgagaggacgatcatccacgctggaactaagacacggtccagcctcctacaggaggcagcagctaggaatatgaagcaatggaggaaactctgacacagccatgccgcgtgaatgaaaaaggccttcgggttgtaaagttcttgtggtcataaagatgatgacagtagtgacagaaaaagcaccggctaacttcgtgccagcagccgcggtaat

SEQ ID NO: 5269 - DNA, 490 bp, Unknown
  Ascusbbf_1372649, encodes 16S rRNA
agagtttgatcctggctcagaacgaacgctggcggcaggcttaacacatgcaagttggacgggaatcgattgatagcttgctattgattgaggagagtagcgcacgggtgagtaacacgtgggaacataccttatagtgggggataacaattggaaactattgcttataccgcttacgtcgtaagggtgaatggagaatttcggtctctgatttgcggggggaagattaggcagttggtggggtaaagtcctaccaaacctacggtctatagctggtctgagaggacgatcagccacattgggactgagacacggcccaaactcctacgtgaggcagcagtggggaatattgggcaatgggggcaaccctgacccagccatgccgcgtgagtgaagaaggttttcgaagtgtaaagctctttcggatgtgaagatgatgacggtagcatctagagaagccccggcaaacttcgtgccagcagccgcggta

SEQ ID NO: 5270 - DNA, 490 bp, Unknown
  Ascusbbf_1325274, encodes 16S rRNA
agagtttgatcctggctcaggatgaacgctagcggcaggcttaacgcatgcaagtcgaggggcagcgcggggtagcaatactctggcggcgaccggcggaagggtgcgtaacgcgtgagcaacttgcccgtcactggaggataggcactggaaacggtgtgtaatactccataacataagttttcgcatgaagatttattgaaagattcattggtgacggatgggctcgcgagacattagctagtcggcggggtaacggcccaccgaggctacgatgtctaggggttctgagaggaaggtccacaacacgggaactgggacacggtccagactcctacgggaggaagcagtgaggagtagtggtaaatgggcggaagcctgaaccagccatgccgagtgaaagaataaggccctatgggtcgtaaacttcttttccttgagggcaataaggatcacgcgtggtccgatgagagtatcaggggaataagca

SEQ ID NO: 5271 - DNA, 490 bp, Unknown
  Ascusbbf_1324949, encodes 16S rRNA
agagtttatcctggctcaggatgaacgctagcggcaggactaagacaggcaagtcgaacgggaaaggtcccgtcggggatatgagagtggcgcacgggggcggaacgcgtatgcaacccacccgctggcgggggatagcccggagaaaggcgaatgaataccccatgaggagacaggacggcatcgtcctgttttcaaaactacggtgacggcggacgggcatgcatgccattagatagttggcggggtaacggcccaccaagtcgacgagggccaggggatcggagaggacggtccccccaccgcgtactggaccccggcccagactcctacgggaggcagcagtaccggatattgggcaatggggggaaccctgaaccagccatgccgcgtgagggattaaggccctacgggtcgtaaacctcttttgccgggggataaagacagcctcgtgaggttgtttgaaggtacccggagaataagcatcggc

SEQ ID NO: 5272 - DNA, 490 bp, Unknown
  Ascusbbf_1341824, encodes 16S rRNA
agagtttgatcctggctcaggatgaacgctagctacaggcttaacacatgcaagtcgaggggcagcgtatcgcacgcttgcttttgatgatggcgaccggcgcacggctgggtaacgcgtttcccaccttccctatattagcgtatagcccggcgtctgtcggcttatatctctttgttcttgggagaagacatctgaaatgaagcaatggtttaccggcatagggtcggcatgcgtctgcttaggttggtggcgggaaaacggctcaccaagtacccgatcagtaggggttctgtgagacaaggccctaacagggggactgggcaacgggcgaaacacctacgggacagagcagtgaggaatattggtgaatggacgagagcctgaagcaggcaagtagcgtgcaggaagacggcccgaggggtggcaaactgctggtagtcagggacaaagtacactacggaaggtattttgtaggtaccggaagaag

SEQ ID NO: 5273 - DNA, 490 bp, Unknown
  Ascusbbf_1377776, encodes 16S rRNA
agagtttgatcatggctcaggataaacgctggcggcgcacataagacatgcaagtcgaacggacttaactcattcttaacgattgagagcggttagtggcggactggtgagtaatatataagtaacctgcctctcagaggggaacaacagttggaaacgactgctaataccgcatatgccacgagcatcacatggttcaagtgggaaaggagcaatccgctgatagataggcttatatctgattagctagttggtggggtaacggccaaacaaggcgacgatcagtagccggcctgagaggttaaacggcacagtggggactgagatacggaccataatccgacgggaggcagcaggcgggaatatggcgcaagggaggaaactcggacgcagtgacgccgcgtgcaggaagaaggttttcggagtgtaaactgctttagacagggaagaaaaaagacagaacctgtagaataggctcgggctaactacg

SEQ ID NO: 5274 - DNA, 490 bp, Unknown
  Ascusbbf_1324948, encodes 16S rRNA
agagtttgatcctggctcaggatgaacgctagcggcagtcttaaccccttcccttctcggggtcacgcggggtagcactcctctggcgacgaccggcgcacgggttcttccctcttcttccccctccctgtacccttggtataacggagagaaatttcccctactcccccatattgttcttctttctcattgtaggataacgaaagcttcggtggttacggatgggcatgcgtgaccttagctagttggtaaggtaacggcttaccaaggtgacgatgtctaggggagctgagaggcttatccaccagacgggcacggagacacggaccagcatcctccgggtggaagcggttaggaatattggtcaatggacggaagtctgaaccagccgtgccgcgtggaggaagaaggtcccatgggttgtaaactccttttgttcgagagtaataagggctttgcgaagcccgatgagagtatcggacgaataagc

SEQ ID NO: 5275 - DNA, 490 bp, Unknown
  Ascusbbf_1325266, encodes 16S rRNA
agagtttgatctggctcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaaagtcggattaataccctatgttttccgttgaggacatctgaagtggaacaaagatttatcgctaagggatggggatgcgtctgattaggttgttggcggggtaacggccaaccaagccatcgatcagtaggggttctgagaggaatgtcccacacgtatggagtgacagacggaccaagctcgtacgggaggagggagtgaggatgattgatcgatggacgaaggactgaaccagccaagttgcgtgcaggaggacgtccggatgggttgtaaactgctattgcaggaagataaagtgtgagacgagtccctttttgtatgtaccatgtgaata

SEQ ID NO: 5276 - DNA, 490 bp, Unknown
  Ascusbbf_1342440, encodes 16S rRNA
agagtttgatcatggctcaggacgaacgctggcggcatgcttaacacatgcaagtcgaagggacggatgaaggagggatgaaaggtaggggtgaaggggggaggaatgtatgagcaaactgcatgtgagaatgggataaaagggggaaaagagggagaagaggggataagaccacggcaccgcatggtgctgcggtaaaagatttttcgggcagagatgggctcatatcccattagctagttggtgagctaatagccaaccaagccgacgatgggtagccgagctgagaggctgatcggcacccttgggactgaaacacggcccagaacactacgggaggcagcagtggggaatattgggcaatggaggaaactctgagccagcaatgccgcgtgagcgatgaaggtaattttattgtaaagctcgtttctcaggaacgaataaagatgacggtacctgaggaataagccccggctaactacgtgccagc

SEQ ID NO: 5277 - DNA, 490 bp, Unknown
  Ascusbbf_1342464, encodes 16S rRNA
agagtttgatcatggctcaggatgaacgctagcggcaggcttaacacatgcaagtcgaggggcagcgcggcgtagccatactctggcggcgagcggcggacgcacgcgtaaggcgtgagtatcttgcccgccactgggtggtaggtaccggaacgagtgtgtaatactccatatcttatggatactgatggctttttattgaaagcttcgtttgtgacggatgggttggcgtaacatcagatagtcggcggggtagcggcccaccgagcctacgatacgtaggggatctgtgaggaaggtcccccacactggacctgggacacggtccaaactcctacgggaggcagcagtgaggaatattggtcaatgggcggaagcctgaaccagccaagccgcgtgcaggaagaaggccctatgggtcgtaaactgcttttccacgagggcaataagggtcacgtgtggccctatgtgagtatcggatgaataagca

SEQ ID NO: 5278 - DNA, 490 bp, Unknown
  Ascusbbf_1445551, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccctattgttagagattcgcatgtttctctaacgaaagcttcggtggttacggtagggcgtgcgtgagattagctaggtggtagggtaacggcttaccaaggcgacgatgtctaggggggctgagaggctgatccccaacactggaactgagacacggaccagactcctacgggaggcagcagtgaggaatattggtcaatggacgagagtctgaaccagccatgccgcgtggaggaagaaggtcctatgggttgtaaactccttttgtgcgggagtaataagaggctcgcgagcctggatgagagtatcggatgaataagc

SEQ ID NO: 5279 - DNA, 490 bp, Unknown
  Ascusbbf_1342452, encodes 16S rRNA
agagtttgatcatggctcaggatgaacgctagctacaggcttaacacatgcaagtcgcggggcatcatggcatgtagcaatacatgctgatggcgaccggcggatgggtgagtaacgcgtatccaacctggccctatctcgggtacagcccctcgaaagagggattaattcccgatgttccctgggatccgcacgttttccagggcaaaggcatttgtcggatagggatggggatgcgttccattaggcagtcggcggggtaacggcccaccgagcctacgatggataggggttctgaggggaaaggccccgcaaactgggactgagaacaggcccggacgcgtacggggggcagcagtgaggaatagtggtcaatggcggtaacgctgaaccagccaagtagcgtgagggattacggccctatgggttttaaacctcttttgttagggagcaaccggtggcactagggcaattctgcgagtacctttcg

SEQ ID NO: 5280 - DNA, 490 bp, Unknown
  Ascusbbf_1373048, encodes 16S rRNA
agagtttgatcctggctcaggataaacgctggctgcgcacataagacatgcaagtcgaacgaacttaatcgaaagtttacttttgaattgggtagtggcggactggtgagtaacgcgtaaacaatctgcctttcagagaggaataacagtgagaaatcattgctaataccgcatcagctgtgagtatcgcatgatacaaatagaaaaggagcaatccgctgttagatgagcttgcgtctgattagttagttggtgtggtaacggactacccagacgatgatcaggagccggactgagagggtaagaggccacggtgggaactagatacggcccaagcacctacgagaggcagcagacgggaatattgcgcaatggaggaaactctgacgcagtgacgccgcgtgcaggaagaaggttgtcggattgtaaaatgctttagatagggaagaaaaaaaatgacggtacctatagaataagctccggctaacta

SEQ ID NO: 5281 - DNA, 490 bp, Unknown
  Ascusbbf_1322023, encodes 16S rRNA
agagtttgatcatggctcaggacgaacgctggcggcatgcttaacacatgcaagtcgaacggactgattccttcgggttgcaagttagtggcgaacgggtgagtaatgtatgatcaacctgcctctatcaacgggataacagttggaaacgactgctaatacggtataagaccacggccccgcctgatgctgcggtaaaagatttttcggctaggaatgggctcatttcccattagctagttggtaggataacagcccaccaaggcgacgattggtagccgagcgtagaggctgatcggccacatagggacggaaacacggcccagactcctacgggaggcagcagtggggaagaatgggcaatggaggcaactctgacccagcaatgccgcgtgagtgatgaaggtaattttattgtaaagctcgtttctcaggaacgaataaagatgacggtacctgaggaataagccccggctaactacgtgccagc

SEQ ID NO: 5282 - DNA, 490 bp, Unknown
  Ascusbbf_1340749, encodes 16S rRNA
agagtttgatcctggctcaggatgaacgctagcggcaggcttaacacatgcaagtcgaggggtaacgcggggtagcaatactctggcgactaccggcgcacgggtgcgtaacgcgtatgcaacctacctttaacaggggtataacggagagaaatttccactaatcccccatattgttattctttcgcatgttaggataacgaaagcttcggtggttacggatgggcatgcgtgacgttagctagttggtaaggtaacggcttaccaaggcgacgatgtctaggggagctgagaggcgtatcccacacacgggaacggagaaacggacaagactccaacgggaggcagcagtggggaatattggtcatggacggaagtcggaaccagccatgccgcgtggaggaagaaggtccgatgggtgggaaactccttttgttcgagagtaataagaggatggcgagcctcgatgagagtatcggacgaataagca

SEQ ID NO: 5283 - DNA, 490 bp, Unknown
  Ascusbbf_1322009, encodes 16S rRNA
agagtttgatcctggctcaggacgaacgctggcggcatgcttaacacatgcaagtcgaacggactgattccttcgggatgaaagttagtggcgaacgggtgagtaatgtatgagcaacctgcctctatcaacgggataacagttggaaacgactgctaatacggtataagaccacggcaccgcatgatgctgcggtaaaagccttttcggagagagatgggctcatatcccattagctagttggtgagataacagcccaccagggcgacgatgggtagccgagctgagaggctgatcggccacattgggcagaaaacacggcgcagactcctacgggaggcagcagtggggaagattgggcaagggcggcaactctgaccccgcaatgccgcgtgggtgatgaaggtaattttattgtaaagctcttttctcaggaacgaataaagatgacggtacctgaggaataagccccggctaactacgtgccagc

SEQ ID NO: 5284 - DNA, 470 bp, Unknown
  Ascusbbf_1322013, encodes 16S rRNA
agagtttgatcatggctcagaacgaacgctggcggcatgcctaacacatgcaagtcgaacgagaccgtcgggtcgagtggcgcacgggtgcggaacgcgggggaaccggcccttaggttcggaagaactcaccgaaaggggggcgaagaccggagaatgtcttcggaccaaagagtgatcgcctttggaggggcccgcgttggatgagcgagttggggaggtaaaggcgcaccaaggcgacgatccagagctggtcgtagaggaggatcagccacactgggactgagacacggcccagactcctccggggggcagccgtggggcctcttggccactgggcgaccgcctgctcccgccctgccgcgtgagtgatgacggccttagggttgtacagctcttttaccagggatgataatgaccgtacctggagactacgctccggctacctccgtgccagcagccgcggtaat

SEQ ID NO: 5285 - DNA, 470 bp, Unknown
  Ascusbbf_1322010, encodes 16S rRNA
agagtttgatcctggctcagaacgaacgctggcggcaggcttaacacatgcaagtcgagcgcccttttcggagggagcggcagacgggtgagtaacgcgggggaatctacccatctctacggaataactcagtgaaacttgtgctaataccgtatacgcccttttggggaaagatttatcggagatgactgagcccgcgttgacttagccacttggcggggtagaggccaaccaaggagacgatctatagctggtctgagaggatgatcagccacactgggactgagacacggcgcagacacgtacgggaggcagcggaggggaatagtagataggcggcgcacgcgtagaacagcgtcgccgtgtgagggatgaaggccctagaggtgtaaagctcgttcaacggtgaagataatgacggtaaccgtagaagaagcaccggctaacttcgtgccagcagccgcggtaat

SEQ ID NO: 5286 - DNA, 490 bp, Unknown
  Ascusbbf_1434924, encodes 16S rRNA
agagtttgatcctggctcaggataaacgctggcggcgcacataagacgtgcaagtcgaacgaacttaatcgaaagtttacttttgtagcggttagtggcggactggtgagtaacgcgtaagcaatctgcctctcagaggggaataatagtgagaaatccttgctaataccgcataagctgtgagtatcgcgtgatacacatagaaaacgaacattccactgttagatgagcttgcgtctggttagttagttggtggggtgacggcctaccaagacgatgatcagtagccggactgagaggttaaacggcaacattgggacacagcaacggaccagacgccaacgggaggcagcagtcgggaagattgcgcaatggaggaaacgcggacgcagtgacgccgcgtgcaggaagaaggttgtcggattgtaaactgctttagatagggaagaaaaaaatgacggtaccgatagaataagcaccggctaactac

SEQ ID NO: 5287 - DNA, 490 bp, Unknown
  Ascusbbf_1372965, encodes 16S rRNA
agagtttgatcatggctcaggatgaacgctagctacaggcttaacacatgcaagtcgcggggcatcgcgaagggtagcaatactctttggcggcgaccggcggatgggtgagtaacgcgtatccaacctggcctatctcgggcacagcccctcgaaagagggattaattcccgatgttcccgttagttcgcatgttctttcgggcaaaggtatttatcggatagggatggggatgcgttccattaggcagtcggcggggtaacggcccaccgagcctacgatggataggggttctgagaggaaggccccccaaccgggaatgagaacagggccagaagtccaacgggaggaagcagggaggaatagtggaaaatggcggtaaggcggaaccagccaagtagcgtgggggattacggccctatgggttgtaaactgcttttatatagggataaagtgatctacgtgtaggttttggtaggtactatatgaa

SEQ ID NO: 5288 - DNA, 490 bp, Unknown
  Ascusbbf_1340740, encodes 16S rRNA
agagttgatcatggctcaggacgaacgctggcggcgtgcctaacacatgcaagtcgaacggggattttgtttcggcagaatcctagtggcgaacgggtgagtaacgcgtaggcaacctgccccccggattgggacaacaccccgaaaggggtgctaataccggatacgaagataataccgcatggtgttattttgaaagatgtcctctatttataagctatcgccgggtgatgggcctacgtccgattagctggttggttgggtaacggcctaccaaggcgacgaacggtagccggtttgagtgacgaaacggcagcctgcggaccgagacacggcccagacacctacgggaggcagcaggggggaatctgccgcaatgggcgaaagcctgacggagcaacgccgcgtgggtgaggaagttcgtcggaacgtaaggcccggttgtacatgacgaacgtgctttctatcaacaacgggaagcaatgacggt

SEQ ID NO: 5289 - DNA, 486 bp, Unknown
  Ascusbbf_1373044, encodes 16S rRNA
agagtttgatcatggctcagaacgaacgctggcggcaggtcttaggcatgcaagtcgaacggacgacagagtggcttgccattctgcagttagtggcgcacgagtgagtaacgcgtgtgaaactgcccttcactggggaataacgtctggaaacggacgctactaccgcatccgccctcacggggcaagatttatcggttgtggtttggcccgcgttggattcgctttttggtggggtaatggcctcccaaggcgatgatccttagctgttcttggatgacgatcagccacgctggaaatgagacacggtccagactccgacgggaggcagcagctaagaatattgggcaatggaggaaactctgacctagccatgccgcgtgaatgaagaaggccttcgggttggaaagttctttgagtcatgaagatgatgacagtagtgacagaaaaagcaccggctaacttcgtgccagcagccgcggtaat

SEQ ID NO: 5290 - DNA, 490 bp, Unknown
  Ascusbbf_1434950, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgacattagctattaggtaaggtaacggcttaccaaggctacgatgtctagggtatctgagaggggtatccgcaacacaggaaaggagacaccgaccacacacctacgggaggcagcagggaggaatattggtcaatggaaggaagtctgaaccagccatggcgcgtggaggaagaagggcctatgggttgtaaactccttttgtacgagagtaataagggcttagcgaagccagatgagagtagcggacgaataagc

SEQ ID NO: 5291 - DNA, 490 bp, Unknown
  Ascusbbf_1340728, encodes 16S rRNA
agagtttgatcatggctcaggatgaacgctagcggcaggcttaacacatgcaagtcgaggggtaacgcggggtagaaataatttggagaagaaagggggaagggggcgtaacgcgtaggtaatagagagggaataggggtagaaaggagagaaatttccactaagcccccatattgttattctttcgcatgttaggataacgaaagcttcggtggttacggatgggcatgcgtgacattagctagttggtaaggtaacggcttaccaaggcgacgatgtctaggggagctgagaggcttatcccacgaactgtgactgagacacggaccagactcctacgggaggcagcagtgaggaatattggtcaatggacggaagtctgaaccagccatgccgcgtggaggaagaagggcctatgggttgtaaactccttttgttcgagagtaataagaggcttgcgagcctcgatgagagtatcggacgaataagc

SEQ ID NO: 5292 - DNA, 490 bp, Unknown
  Ascusbbf_1372853, encodes 16S rRNA
agagtttgatcatggctcaggatgaacgctagcggcaggcttaacacatgcaagtcgaggggcagcgcggggtagcaatactctggcggcgaccggcggaagggtgcgtaacgcgtgagcaacatgcccgtggcagggggataagcgatggaaacgtcgtctaagaccccgtaacaacagacctcgcatggggtttgtttgaaagcttcggcggccacggattggctcgcgtcccattaggcagttggcggggtaacggcccaccaaaccgacgatgggtaggggttctgagaggaaggtcccccacagtgaaacagggacacggtcccaatccttccggagggaggcgttgaggaaacttggtcaaggggcggagccctaaaccagccaggccgcgttcaggaataaggccctacgggtcgtaaactgcttttgtacgggagcaataagggtcacgagtggcctgaagagagtaccgtacgaataagca

SEQ ID NO: 5293 - DNA, 490 bp, Unknown
  Ascusbbf_1322220, encodes 16S rRNA
agagtttgatcctggctcaggatgaacgctagcggcaggcttaacacatgcaagtcgaggggtaacgcggggtagcactactctgtcgacgaccgtcgcacgggtgcgtagcgcgtatgcaacctacctgtaacaggggtataacggagagaaatttccactcatcccccatattgttagagattcgcatgtttctctaacgaacgcttcgttggttactgatggtcatgcgtgacattagctagttggtaaggtaacggcttaccaaggcgactctgtctagtggagctgggaggcttatcaccagcactggtacggagacacggaccagactcctacgggaggcagcagtgaggaatagtgggcaatggacggaagtctgaaccagccatgcagcgtggaggaagaaggtcctatgggttgtaaactccttttgttcgagagtaagaagaggcgtgcgagcctcgatgagagtatcggacgaataagc

SEQ ID NO: 5294 - DNA, 490 bp, Unknown
  Ascusbbf_1341102, encodes 16S rRNA
agagtttgatcatggctcaggacgaacgctggcggcatgcttcacacatgcaagtcgaacggactgattccttcgggatgaaatttcttatcgaacgggtgagtaatgtatgagcaacctgcctctgtcaacggtataacagttgtaaacgactgctaatacggtataagaccacggcaccgcatggtgctgcggtaaaagttttttcggacatcgatgggctcatatcccattagctagttggtgagataatagcccaccaaggcgacgatgggtagccgagctgagaggctgatcggccacattgggactgaaacacggcccagactcctacgggaggcagcagtggggaagattgggcaatggaggaaacgctgacccagcaatgccgcgtgagcgatgaaggtaattttattgtaaagcgcgtttctcaggaacgaataaagatgacggtacctgaggaataagccccggctaactacgtgccagc

SEQ ID NO: 5295 - DNA, 490 bp, Unknown
  Ascusbbf_1322142, encodes 16S rRNA
agagtttgatcctggctcaggatgaacgctggcggcgtgcttaacacatgcaagtcgaacgaggtacaaggacggatgttttcggacggaagatcttgtactgagtggcggacgggtgagtaacgcgtgggaaacctgccctgttccgggggataccagttggaaacgactgttaataccgcataagcgcacagcaccgtatggcgcagtgtgaaaacatccggaggaataggatggtccagcgtctgattagggagtaggcagggtaacggcctacgaaaccgacgatcagtagccggcctgagatagtgcacagccacatagggacggaggcacgacccaaaatcctacagggggcggcagtcgggagtattgcacaaggggggaaaaccagatgcagcgacgccgcgagagggaagaggtatttcagtatgtaaagctctggcagcagggaagaagatgacggtacctgcaaaagcagccccggcta

SEQ ID NO: 5296 - DNA, 490 bp, Unknown
  Ascusbbf_1373031, encodes 16S rRNA
agagtttgatcctggctcaggatgaacgctagcggcaggcttaacacatgcaagtcgaggggcaacgcggggtagcaatactctggcgacgaccggcccacgggtgcgtaacgcgtatgtaacctacctgtaacaggggtataacggagagaaatttacactaatcccccatattgttattctttcgcatgctaggataaagaacgcttcggtggctacggttgggcatgcgtgacattagttagttggtaaggtaacggcttaccaagccgacgatgtctaggggagctgagaggcttatcccccacactggaactgagacacggaccaaactcctacgggaggcagcagtgaggaatattggtcaatggacgtaaggctgaaccagccatgccgcgtgggggaataaggtcctatgggttgtaaactccttttgttcgggagtaataagggctttgcgaagcccgatgagagtatcggacgaataagc

SEQ ID NO: 5297 - DNA, 490 bp, Unknown
  Ascusbbf_1373020, encodes 16S rRNA
agagtttgatcctggctcaggatgaacgctagctacaggcttaacacatgcaagtcgaggggcagcataacgaaagcttgcttttgttgatggcgaccggcgcacgggtgagtaccgcgtctccaaccttccccttagtagggcatagcccggtgaaagtcggattaataccctatgttttccgtttaggacatctgaagtgtaacaaagatttatcgctaagggatggggctccgtctgtttaggttgttggcgggtaaacggcccaccaagccatagatcaatagggggtctgagaggaaggtcccgcgcagtgggaccgagaaacggaccaaactcctacgggaggcagcagtgaggaatattggtcaatgggcgagagcctgaaccagccaagtagcgtgcaggatgacggccctatgggttgtaaactgcttttgcatgggaataaagtgagggacgtgtccctttttgtatgtaccatgagaat

SEQ ID NO: 5298 - DNA, 490 bp, Unknown
  Ascusbbf_1373027, encodes 16S rRNA
agagtttgatcatggctcaggatgaacgctagctacaggcttaacacatgcaagtcgaggggcagcataacgaaatcttgcttttgttgatggcgaccggcgcacgggtgagtaacgcgtatccaaccttccccttagtagggcatagcccggcgaaagtcggattaataccctatgttttccgttgaggacatctgacgtggaataaagatttatcgctacgggatggggttgcgtctgtttgggttgttgtaggggtaacggcccaccaagccatcgatcagtagtggttctgtgaggaaggtaccccgaactggtacggagacacggaccaaactcgtacgggaggcagcagtgaggaagactggtcaatgggcgagagcctgaaccagccaagtagcgggcaggatgacggccctatgggttgtaaactgcttttgcatgggaataaagtgagggaagtgtccctttttgtatgtaccatgagaat

SEQ ID NO: 5299 - DNA, 490 bp, Unknown
  Ascusbbf_1435063, encodes 16S rRNA
agagtttgatcctggctcaggatgaacgctagctacatgcttaacacatgcaagtcgaggggaaacgatatcgaaagcttccttttgatcggcgtcgaccggcgcacgggtgagttacgcgtctcccacctgcctgtaaattgggcataatccgtggtaacgcggcctaatgtcctatgtgctccgaataggacatcttttttggagtaaagattcatcgtttccggatggggatgcgtctgcttggcttgctggctgggttaagaccccccagggcgacgatcagtaggggttcttagagtaaggtcaacgacattggaaatgagacacaatccaaactgctacggggagcaaaagagaggaatattgggcaatggacgagaatctgaaccagccgagtggcgtgcaggatgacggccgtatgggttgtaaagtggttatatgcggggataaagtgagcaacgcatggtgtattgcaggtaccgcaaga

SEQ ID NO: 5300 - DNA, 490 bp, Unknown
  Ascusbbf_1340762, encodes 16S rRNA
agagtttgatcctggctcaggatgaacgctagcggcaggcttaacacatgcaagtcgcggggtaacgcggggtatcaatactctggcgacgaccggcgcacgggtgcgtaacgcttatgcaacctacctgtaacaggggtataacggagagaaattttcactaatcccccatattgttagagattcgcatgtttctctaacgaaagcttcagtggttccgtatgggcctgcgtaacattagctagttggtaagttaacggcttacaacggcgactatgtctaggggagctgatacgcttatcccacacactgggactgagacacggaccagactcctacgggaggcagcagtgaggaatagtggtcaatggacggaagtctgaaccggccatgccgcgtggaggaagaaggtcctatgggttgtaaactccttttgttcgagagtaataagaggcttgcgagcctcgatgagagtatcggacgaataagc

SEQ ID NO: 5301 - DNA, 490 bp, Unknown
  Ascusbbf_1372861, encodes 16S rRNA
agagtttgatcctggctcaggatgaacgctggctgcgggcttaacacatgcaagtcgaacggacttaactcattcttaacgtttgagagctgttgatggcggactggtgagtaatgtctaattaaccttcctatctgaggggaacaacagttggagacgactgctaataccgcatatgccacgataatcacagtgttcaagtgggaaaggagcaatccgctgataaatggacttctatctgtttagctagttggtggggtaacgccctaccaaggcgacgatcagtagccggactgagaggtgagacggcgacaatgggactgaggtacggaccagactgcaacgggaggcagcagtcgggaaaattgagcaatggaggagagtgcaacgcagtgacgctgcgtgaaggaagaaggttttcggattgtaaatgctttcgaaagggaagaaaaaagacagtacctgaagaataaggaccggctaactacgt

SEQ ID NO: 5302 - DNA, 490 bp, Unknown
  Ascusbbf_1435051, encodes 16S rRNA
agagtttgatcctggctcagaatgaacgctagcgacaggcctaacacatgcaagtcgaggggcagcgcgggagaagcttgcttttcctggcggcgaccggcgcacgggtgcgtaacaggtgtgcaatctgtccatagtcggggaatagcccagcgaaagttggattaatgctccatgtgtcacgaagccgcattactttgtgatgaaacgtaaggacgatgggtgagcaggctgctgttgagatagttggtggggtaacggctcaccaagtcgacgatcagtagtggttctgagaggaaggccccccacatgggaccggagaaccggccaaatcccccacgggaggcagaaggaaggatgattggtcaatgggcgagggcctgaaccagccaagtcgcgtgaagaatgaaggttctagggattgaaaacttcttttgtccgagggtaaaaaggccacgtgtggcttcttgcaagtagtggacgaataagc

SEQ ID NO: 5303 - DNA, 490 bp, Unknown
  Ascusbbf_1436335, encodes 16S rRNA
agagtttgatcatggctcaggatgaacgctagcggcaggcttgacacatgcaagtcgaggggcagcgcggggtagcaatactctggcggcgaccggcgggcgggtgcgtaacgcgtgcgcaacttgcccgtcactggggggtaggcactggaaacggtgtgtaatactcactaacatatggattcacatggatttatattgaaagattagttggtgccggatgggatcgagtaacattagatagtcgggggggtaacggccccccgaggctacgctgtttaggggttgtgagaggaaggtgccccacactggaactgaggcacggtccagactcctacgggaggcagcagtgaggaatattggtcaatgggcggaagcctgaaccagccatgccgcgtgcaggaataaggccctatgggtcgtaaactgcttttccttgagggcaataagggtcacgtgtggcccgatgagagtatcatgggaataagca

SEQ ID NO: 5304 - DNA, 490 bp, Unknown
  Ascusbbf_1341507, encodes 16S rRNA
agagtttgatcctggctcaggataaacgctggcggcgcacataagacatgcaagtcgaacgaacttaatcgaaagtttacttttgaagcggttagtggcggactggtgagtaacgcgtaagcaatctgcctatcagaggggaataacagtgagaaatcattgctaataccgcataagctgtgagtatcgcatgatacaaatagaaaaggagcaatccgcttatagatgagcttgcgtctgattagttggtaggtggggtaacggcctaccaagactatgatcagtagccggactgagaggttatacggcccgattcggactgagatacggcccagactcctacgggagggagcagtcgggaacattgcgaaatggacgaaacgcggacgcagtgacgccgcgtgcaggaagaaggttttcggattgtaaactgcattagatagggaagaaaaaaatgacggtacctttagaataagctccggctaactac

SEQ ID NO: 5305 - DNA, 486 bp, Unknown
  Ascusbbf_1322360, encodes 16S rRNA
agagtttgatcctggctcagaacgaacgctggcggcaggtcttaggcatgcaagtcgaacggacgactgagtggcttgccattctgaagttagtggggcacgagtgagtaacgcgtgggaaactgcccttcactggggaataacgtctggaaacggacgctaataccgcatacgcccgcaatgggaaagatttatatgtgatggatgtgcccgcgttggattagcttgttggttgggtaatggccgaccaaggcgatgatccatacatggtctgagaggacgatcagccacgctggaacttgtgcacgggccagactcgtacggaaggcaggagctaagaatattgggcaatggaggcaacgctgacccagccatgccacgtgaatgaagaaggccttcgggtgggaaagtacttttagtcatgaagatgatgacagtagtgacagaaaaagcaccggctaacttcgtgccagcagccgcggtaat

SEQ ID NO: 5306 - DNA, 490 bp, Unknown
  Ascusbbf_1340850, encodes 16S rRNA
agagtttgatcctggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgacattagctagttggtaaggtaacggcttaccaaggcgacgatgtctaggggagctgagaggcttatcgccaccgctgggactaacacacggaacggactcctaccgcaggcaggagtgcgtagggttggagaaggaacgaaagtcggaacctgccaggacgcgtgaaggaagaaggtcgtatgggttgtaaacgcctttgggtcgtgagtaataagggcatggcgaagcccgatgagagtaccggacgaagaagc

SEQ ID NO: 5307 - DNA, 490 bp, Unknown
  Ascusbbf_1322366, encodes 16S rRNA
agagtttgatcctggctcaggatgaacgctagcggcaggcttaacacatgcaagtcgaggggtaacgcggggtagcaatactctggcgacgacctgcgcacgggtgcgttatgcgtatgccaccttcctgtaacaggggtataacggagacaaatttccactaatcccccatattgttattctttcgcatgttaggataacgaaagcttcggtagttacgcatgggcatgggtaacattagctagtgggaaaggaacgggcttaccaaggcgacgatgtctaggggagctgagaggcttatcccccacactggtactgagacacggaccagaatcctacgggaggcagcagtgaggaatattggtcaatggacggaagtctgaaccagccatgccgcgtggaggaagaaggtcctatgggttgtaaactccttttgttcgagaataataagggctttgcgaagcccgatgagagtaccgtacgaataagc

SEQ ID NO: 5308 - DNA, 490 bp, Unknown
  Ascusbbf_1371844, encodes 16S rRNA
agagtttgatcatggctcaggatgaacgctagcggcaggcttaacacatgcaagtcgaggggtaacgcggggtagcattactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgttacattagctagttggtaaggtaacggcttaccacggcgaggatgtctaggggggctgagaggcttaacctccacagtggtacgtggacacggaccagactcctacgagaggcaaaagtgaggaataatgggcaatggacggaagtctgaaccagccatgccgcgtggaggaagaaagtcctatgggttgtaaactccttttgttcgagagtaataagaggcttgcgagcctcgatgagagtatcggacgaataagc

SEQ ID NO: 5309 - DNA, 490 bp, Unknown
  Ascusbbf_1436153, encodes 16S rRNA
agagtttgatcctggctcaggatgaacgctggcggcgtgcctaacacatgcaagtcgaacggaaagaattcttcgggattcttccagtggcggacgggtgagtaacgcgtgggtaacctgccccatccaggtgaacaacagctggaaacggctgctaataccgcataagcgcccagtactgcatggtacagtgtgaaaagtttttatcggaatgggatggacccgcgtctgattagcttgttggagggggaacagcccaccaaggcgtcgatcagtagccgacctgagagggtgaccggccagattgagactgagacgcggaccaaactcctacgggggcagcagtggcggatattgcacaatgggcgaaagccagatgcagcgacgccgcgggagtgaggaagtatttcggtatgtaaagctctaacagtagggaagaaaatgacggtacctgactaagaagccccggctaactacgtgccagcagccg

SEQ ID NO: 5310 - DNA, 490 bp, Unknown
  Ascusbbf_1341436, encodes 16S rRNA
agagtttgatcctggctcaggatgaacgctagcgacaggcctaacacatgcaagtcgaggggcagcgcgggagaagcttgcttttcctggcggcgaccggcgcacgggtgcgtaacaggtgtgcaatctgtccatagtcggggaatagcccagcgaacgttggattaatgctccatgtgtcacgaagccgcatgactttgtgatgaaacgtacggactatgggtgagcacgcttctgattagatagttggtgaggtaacggctcaccaagtctacgatcagtaggggttctgagcgggagggcacccacatgggaaatgagcacccgtccaaacgcctccgggaggaagcagtgaggaatattggtcaatgggcgagagcctgaaccagccaagtagcgtgcaggatgacggccctatgggttgtaaactgcttttatacggggataaagtgagggacgtgtccctttttgtaggtaccgtatgaataag

SEQ ID NO: 5311 - DNA, 490 bp, Unknown
  Ascusbbf_1436306, encodes 16S rRNA
agagtttgatcatggtcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaaagtcggattaataccctatgttttccgttgaggacatctgaagtggaacaaagatttatcgctaagggatggggatgcgtctgattaggttgttagcggggtaccggcccaccaagccatcgatcagtaggggttctgagaggaaagtcacatacatgcggactgtggaccggactgaactgctacgggggcgagcagtgaggaatattggtcgatgggcgagagcctgaaccagccaagtagcgtgcaggatgacggccctatgggttgtaaactgcttttgcatgggaataaagtgagggacgtgtccctttttgtatgtaccatgagaata

SEQ ID NO: 5312 - DNA, 490 bp, Unknown
  Ascusbbf_1341433, encodes 16S rRNA
agagtttgatcctggctcagaacgaacgctggcggcaggcttaacacatgcaagtcggacgggaacctattgatagcttgctattgtttgaggcgagtagcgcacgggtgagtaacacgtgggaacataccttatagtgggggataacaattggaaacgactgataataccgcataagtcctaagggagaaaggagcaattggctataagattggcccgcggaagattaggcagttggtggggtaaaggcctaccaaacctacgatctctagctggactgagaggacgaacagccacattgcgcctgagacacggagcagacaccaacgggggtcaacagtggagaatattaagcagtggggtaaagtctggcacagctgcgccgtgtgagggaaacagcttttcgaagtgaaaaactcttggggatgtgaagatgatgacggtagcatctgaagaagcaccggctaactccgtgccagcagccgcggta

SEQ ID NO: 5313 - DNA, 490 bp, Unknown
  Ascusbbf_1340868, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctccctctaacagggatgtaacggagagaaatttcaactaatcctccatactcatagagattcgcatgtttctctaatgatagcttcggtgtttacggatggacaggcgtaacattagctagttggtctggtaacggctcaccaaggcgacgatgtctaggggagctggggggctcatcgcccacactggtacggagacacggacaatactcctacgagaggaagcagtgaggaagattggtcaatggacggaagtctgaaccagccaggccgcgtggaggaagacggtcctatgggttgtaaactccttttgttcgagagtaataagaggcttgcgagcctagatgagagtatcggacgaagaagc

SEQ ID NO: 5314 - DNA, 490 bp, Unknown
  Ascusbbf_1322083, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtaagcaacatgcccgtggcagggggataagcgatggaaacgtcgtctaagaccccgtaacaacagacctcgcatggggtttgtttgaaagcttcggcggccacggattggcccgcgtcccattaggcagttggcggggtaacggcccaccaaaccgacgatgggtaggggttgtgagaggaagggcccgaacgatggaacggacacacgatccacacacttacgcgaggcacaagtgaggaatagtggtcaatggagggaagcctgaaccagccatgccgcgtgcaggaagaaggccctacgggtcgtaaactgcttttgtacgggagcaataagggtcacgagtggcctgatgagagtaccgtacgaataagca

SEQ ID NO: 5315 - DNA, 488 bp, Unknown
  Ascusbbf_1322066, encodes 16S rRNA
agagtttgatcctggctcagaacgaacgctggcggcaggcttaacacatgcaagttgagtgggatcgattagtagctcgctattgatcatgagagcagcgcactggtgagtaacacgtgggaacatactttttggcgggggacaacagctcgaaacgactgctaataccgcataagccctgagggggaaagcttattagccgagagattggcccgcggcagattaggtagtaggtggggtaacggcctacctagccgacgacctctagctggtctgagaggacgatgagccacattggaacgtaggcacgggccagtcacatgctagaggcggcagtggcgcaaagtgggcaatgggtgcaactctgggacagcaatgacacgtgagggaagagggttgtcggggaggaaagctcgttcatacaggaagaggaggacggtacggtgagaagaagcacgggggaacttcgtgccagcagccggggtaat

SEQ ID NO: 5316 - DNA, 490 bp, Unknown
  Ascusbbf_1434931, encodes 16S rRNA
agagtttgatcctggctcaggatgaacgctggcggcgtgcttaacacatgcaagtcgaacggagttatctcgctgaggagtgcttgctcaactcttgagataacttagtggcggacgggtgagtaacgcgtggataacctgccttatactgggggataacacttagaaatcggtgctaataccgcataagcgcacgttcccgcatgggaaagtgtgaaaaactccggtggggtaagatggatccgcgtctgattagagagttggtgaggtaacggcccaccaagtcaacgatcagtagccggcctgggaggttgaacgggcacatagggacaggggcacggcccaaaatcctacgggaggcagcagtgaggaatattgcacgataggggaaacccggatgcagcgccgccgcgtgagtgaagaagtatgtcggtatgtaaagctctatcagcaaggaagaaaaaaatgacggtacttgactaagaagccc

SEQ ID NO: 5317 - DNA, 490 bp, Unknown
  Ascusbbf_1435028, encodes 16S rRNA
agagtttgatcatggctcaggatgaacgctagcggcaggcttaacacatgcaagtcgaggggtaacgcggggtagcaatactctggcgacgaccggcgcacgggtgcgtaacgcgtatgcaacctacctgtaacaggggtataacggagagaaatttccactaatcccccatattgttattctttcgcatgttaggataacgaaagcttcggtggttacggatgggcatgcgtgacagtagctagttggtaaggtaacggcttaccaaggcgacgatgtctaggggagctgagaggcttatcgcgaccactagtaagatgagacggaccagaatacagcgagaggcagcagtgcggaagattggacaatggagggaagtctgaaccagccatgccgcgtggaggaagaaggtccgatgggttgtaaactccttttgttcgagagtaataagaggcttgcgagcctcgatgagagtatcggaagaataagc

SEQ ID NO: 5318 - DNA, 490 bp, Unknown
  Ascusbbf_1435009, encodes 16S rRNA
agagtttgatcctggctcaggatgaacgctagcggcaggcttaacacatgcaagtcgaggggcatcgcggggtagcaataccctggcgtcgaccggcgcaagggtgcgtaacgcgtgagcgacattcccgtcacagggggataaccggcggaaacgccgcctaataacccatatgaggccaggccacatggccgggccttgcaagtccaggcggtgacggattccctcacgaccgattagccagttgggggggcaacggcccacccaggcgacgatcggtaggggttctgagaggaaggccccccaccacgacaataaaccaccgaccatcttccgacgggaggcagcagggaggattgctgggcaaggggaggacgcctgaaccagccacgcggggggcaggaatgcgtccgtacggttcgtgaactgcgtttcgcgcggagcaagaagaggagttcgcccctccgatgagagtacgcgcggaataagc

SEQ ID NO: 5319 - DNA, 162 bp, Unknown
  Ascusbbf_1434976, encodes 16S rRNA
agagtttgatcctggctcaggatcaacgctggcggcgctcacaagacatgcaagcgtgccggaagccggtttacggattgtgaaatgattggggcagggcggcaaagggaccggacctggatggataacaacggctgaagtcgcggacgcggcagcgagacg

SEQ ID NO: 5320 - DNA, 490 bp, Unknown
  Ascusbbf_1371687, encodes 16S rRNA
agagtttgatcatggctcaggacgaacgctggcggcgtgcttaacacatgcaagtcgaacggtaaggccctttcgggggtacacgagtggcgaacgggtgagtaacacgtgggtaatctgccctgcacttcggattaacccggggaactgggtcttatacccggtatttcgccttcattgcctggtgggtgtttggaagtttttcggtgtgggttgagtccgcggcctttccgcgtgtttgttgggtaagggccttcccaggcggcgacgggtagccggccttagagggggatcggccaccctgggactgagacacggcccagactcctacgggaggcagcagtggggaatattgcacaatgggcgaaagcctgatgcagcgacgccgcgtgggggatgacggtcttcggattgtaaacccctttcagtagggacgaagcgcaagtgacggtacctgcagaagaagcaccggccaactacgtgccagcag

SEQ ID NO: 5321 - DNA, 365 bp, Unknown
  Ascusbbf_1322080, encodes 16S rRNA
agagtttgatcatggctcagattgaacgctggcggcaggcctaacacatgcaagtcgagcggatgaagggagcttgctcctggatttagcggcggacgggtgagtaatgcctaggaatctgcctggtagtgggggataacgtccggaaacgggcgctaataccgcatacgtcctacgggaggaagcagtgggccttagtgccttacgctatcaggcctgcctcagtcaggttaggtttgtgaagaaggtcttcggaatgtaaagcactttcagttgggaggaagggttgtagattaatactctgcaattttgacgttaccaacagaataagcaccggctaacttcgtgccagcagccgcggtaat

SEQ ID NO: 5322 - DNA, 486 bp, Unknown
  Ascusbbf_1434987, encodes 16S rRNA
agagtttgatcatggctcagaacgaacgctggcggcaggtcttaggcatgcaagtcgaacggacgacagagtggcttgccattctgaagttagtggcgcacgagggagtaacgcgtgggaaactgcccttcactggggaataacgtctggaaacggacgctaataccgcatacgcccgcaagaggaaagatttatcggtgattgatgtgcacgcgttggattagcttgttggtggggtaatggcctaccaaggcgatgatccatagctggtctgagaagacgatcagccacgctggaactacgagacggaccagacacctacgggaggcagcagcgaagaatattgggcaatggaggaaactctgagctagcaatgccgcgtgaatgaagaaggccttcgggttgaaaagttctattagtcatgaagatgatgacagtagtgacagaaaaagcaccggctaacttcgtgccagcagccgcggtaat

SEQ ID NO: 5323 - DNA, 490 bp, Unknown
  Ascusbbf_1322239, encodes 16S rRNA
agagttgatcatggcacaggatgaacgctggcggcgtgcctaagacaggcaagtcgaacgagggttctcgtcggggaaaccgagtggcgaacgggggaggaacacataggtaatctacctttcagaaggggagacccaagagaaaggtgggctaataccgtatacaatcgtttctccgcatggagatttgatgaaaggggctccaaagcctcgctgttagatgaacctgtggcacattagctagttggtgagataacagcccaccaaggcgaagatgtgtagccgatctgagaggataatcggccacaatgggactgagacacggcccgtactcctacgggaggcagcagtagggcgttttcggcaatgggggaaaccctgaccgagcaacgccgcgtgatttagaaggccctctgggtcgtaagaatctgttgtaaaggagaaatggtagtgggaggaaatgcccattatttgatagtactttattaga

SEQ ID NO: 5324 - DNA, 490 bp, Unknown
  Ascusbbf_1371712, encodes 16S rRNA
agagtttgatcctggctcaggacgaacgctggcggcatgcttaacacatgcaagtcgaacggacggattccttcgggatgaaagttagtggcgaacgggggagtaatgtatgagcaacctgccgctatcaacgggagaacagtgggaaacgacggctaatacggtagaagaccacggcaccgcaggaggcggcggtaaaagatgggtcggatagagatgggcccagatcccatgagctagttggtgagataacagcccaccaaggcgacgaggggtagccgagcggagaggcggatcggccaccttgggactgcaccacggcccagcctcctccgggaggccgccgtggggcctcttgggcactggaggcccctctgcccccgcactgccgcgtgcgtgatgaaggtccttttcttgtcaagctcttttctcaggaacgcatacagatgacggtacctgaggaatccgccccggctaactacgcgccagc

SEQ ID NO: 5325 - DNA, 490 bp, Unknown
  Ascusbbf_1341112, encodes 16S rRNA
agagtttgatcctggctcaggataaacgctggcggcgtacataagacatgcaagtcgaacgaactcaatcgaaagtttacttttgaagcggttagtgccggaccggtgagtaacgcgtaagcaatccgcccatcagaggggaacaacagcgagaaatcatcgccaacaccgcataagctgtgagtatcgcatgacacaaatagaaaaggagcaatccgctgagagatgagcttgcgtctgattagttagttggtggggtaacggcctaccaagacgattatcagtagccggactgagagggtcagcggccacattggggctgggatccgacccagactcctacgggaggcggcagtcggggatattgcgcaatgggggaaacgctgacgcagtgacgccgcgtgcaggaagaaggttttcggattgtaaactgctttagatagggaagaaaaaaatgacggtacctatagaataagctccggctaactac

SEQ ID NO: 5326 - DNA, 490 bp, Unknown
  Ascusbbf_1373071, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacggtgtgtaatactccataatatatggattcacatggattcatattgaaagattcgttggtgacggatgggctcgcgtaacattagctagtcggcggggtaacggcccaccgaggctacgatatttaggggttctgagaggaaggttgccagtacgggaacgagacaacggaccagactctgacgggaggcagaagggaggaatattggtcaatgggcggaagctggaccaagccatgcggcgggaaggaataaggccctatgggtcgtaaactgcttttcattgagggcaataagggtcacgagtggcccgatgagggtctcaggggaataagca

SEQ ID NO: 5327 - DNA, 468 bp, Unknown
  Ascusbbf_1434818, encodes 16S rRNA
atagtttgatcctggctcagaacgaacgctggcggtaggcttaacacatgcaagtcgagcgccccgcaaggggagcggcagactggtgagtaacgcgtgggaatctacccatctctacggaataactcagggaaacttgtgctaataccgtatacgcccttctggggaaagatttatcggagatggatgagcccgcgttggattagctagttggtggggtaaaggcctaccaaggcgacgatccctagctggtctgagaggatgatcagccacactgggactgagacacggcccagactcatgcgggggggaggagggggggagattggaaaaggggaggcagcctggaacagacatggcggggaaggagtggaggcccgaggggtagaaagcttttttaccggtgaagataatgacggtagtcggggaagaagccccggctaactacgtgccagcagccgcggtaat

SEQ ID NO: 5328 - DNA, 468 bp, Unknown
  Ascusbbf_1373109, encodes 16S rRNA
agagtttgatcatggctcagaacgaacgctggcggcaggcttaacacatgcaagtcgagcgccccgcaaggggagcggcagacgggtgagtaacgcgggggaagcgacccatcgcgacggaagaacgcagggaaacgggggctaataccggagacgccctgcgggggaaagatttatcggagatggaggagcccgcgttggatgagcgagttggtgaggtaaaggctcaccaaggcgacgatccatagcggggccgagaggatgatcagccacactgggactgagacacggcccagacgcctccgggcggcagccgtggggcatcttggccactgggcgcccgcctgctcccgccctgccgcgtgcgtgatgacggccctagggttgtccagctctttcaccggtgacgctaatgccggtacccggagacgccgccccggctaccttcgtgccagcagccgcggtaat

SEQ ID NO: 5329 - DNA, 490 bp, Unknown
  Ascusbbf_1341015, encodes 16S rRNA
agagtttgatcctggctcaggatgaacgctagcggcaggcttaacacatgcaagtcgaggggcagcgcggggtagcaatacttctggcggcgaccggcggaagggtgcgtaacgcgtgagcaacatgcccgtggcagggggatacgcgatggaaacgtcgtctaagaccccgtaacaacagacctcgcatggggtttgttagaaagcttcggcggccacggcttggctcgcgtcccattaggcagtttgcggggtaccggcccaccaaaccgccggggggtcgggggtcttagcggaaggtcaccagcagtggaactgagacacggtccatactcctgcgggaggcagcagggaggaatattggtcaatgggcggaagcctgaaccagccatgccgcgggcaggaagaaggccctacgggtcgtaaactgcttttgtacgggagcaataagggtcacgagtggcctgatgagagtaccgtacgaataagc

SEQ ID NO: 5330 - DNA, 490 bp, Unknown
  Ascusbbf_1373090, encodes 16S rRNA
agagtttgatcctggctcaggataaacgctggcggcgcacataagacatgcaagtcgaacggacttaaatcattgttaacgattgagagcggttagtgggggagtggtgagtaatgtataggtaatgtgcgtatgagaggggaacaacaggtggaaacgactgataatagcgcatatgccacgagaatcacatgggtcaagtggggaaggaggaaaccgctgaaagatcgacttatatatgaataagaagatggtggggtaacagcataccaaggcgacgagcagtagccggactgagaggttaaccggccaaattgggactgagctacggcccagactacgacggaaggcagcagacgggaatattgcgcaatggaggatactctgacgcagtgacgccgcgtgcaagaagaaggttttcggattgtaaactgctttagacagggaagaaaaaagacagtacctgttgaataagcaccggctaactacg

SEQ ID NO: 5331 - DNA, 490 bp, Unknown
  Ascusbbf_1341006, encodes 16S rRNA
agagtttgatcatggctcaggatcaacgctggcggcgcacataacacacgcaagtcgaacggacttaactcattcttaacgcttgagagcgggtagtggcggactgttgattactgtattacaaacctccctatcagaggggaacaacagttggaaacgactgttaatcccccttatgccacgagaatcacatggttcaagtgggaaaggatcaatccgcttttagatggaattatatctgctgagctagttgttggggtcacggcctaccaaggcgacgatcagttgccggactgagaggttaagaagccacactgggactgaggtacggaacagactcctacggtgggcagcagtcgggaatattgcgcaatggaggaaactctgacgcagggacgccgcgtgcaggaagaaggttttcggattgtagactgctgtagacagggaagaaaaaagacagtacctgtagaataagctccggctaactacg

SEQ ID NO: 5332 - DNA, 490 bp, Unknown
  Ascusbbf_1324874, encodes 16S rRNA
agagtttgatcatggctcaggatgaacgctagcggcaggcttaacacatgcaagtcgaggggcagcgcggggtagcaataccctggcggcgaccggcggaagggtgcgtaacgcgtgagcaacttgcccgtcactgggggataggcactggcaacggtgagtaatactcaataacatatggatgcacatggagttatattataagattcgttggtgacggatggtctcgcgtaacgttagctagtcggcggggtaacggcacaccgaggctacgaggtttaggggttctgggaggaaggtccccacccgtggaactgggacacggtccagactcctacgggaggcagcagtgaggaatattggtcaatgggcggaagcctgaaccagccatgccgcgtgcaggaataaggccctatgggtcgtaaactgcttttccttgagggcaataaggatcacgtgtggcccgatgagagtatcaggggaataagca

SEQ ID NO: 5333 - DNA, 490 bp, Unknown
  Ascusbbf_1373117, encodes 16S rRNA
agagtttgatcctggctcaggatgaacgctagcggcaggcttaacacatgcaagtcgaggggcagcgcggggtagcactatcctggcggcgaccggcggaagggtgcgtaacgcgtgagcaacttgcccgtcactggaggataggcactggaaacggtgtgtaatactccataacatcagttttcgcatgaagctttattgaaagattcattggtgacggatgggctcgcgagacattagctagtcggcggggtaccggcccaccgaggctacgatgtctaggggttctgagaggaaggtcacgcacacgggacctgagacacggcccagaagcctacgggaggcagcagtgaggaatattggtcaatgggcggaagcctgaaccagccatgccgcgtgaaggaataaggccctatgggtcggaaacttcttttccgtgggggcaagaaggatcacgcgtggtccgatgagagtaccaggggaataagca

SEQ ID NO: 5334 - DNA, 486 bp, Unknown
  Ascusbbf_1434811, encodes 16S rRNA
agagtttgatcctggctcagaacgaacgctggcggcaggtcttaggcatgcaagtcgaacggacgacagagtggcttgccattcttcagttagtggcgcacgagtgcgtaacgcgtgggaaactgcccttcactggggaataacgtctggaaacggacgctaataccgcatcctcccgcaatgggaaggatttatcggtgatggatgtgcccgcgttggattagctttttggtggggtaatggcctaccacggcgatgatccatagctggtctgagaggacgatcagccacgctggaactgagacacgggccagaatgctacgggaggcagcagctaagaatattgggcaatggaggaaactctgacccagccatgccgcgtgaatgaagaaggccttcggggtgtaaagttcttggagtcatgaagatgatgacagtagtgacagaaaaagcaccggctaacttcgtgccagcagccgcggtaat

SEQ ID NO: 5335 - DNA, 490 bp, Unknown
  Ascusbbf_1324757, encodes 16S rRNA
agagtttgatcatggctcaggatgaacgctggcggcgtgcttaacacatgcaagtcgaacggggattatttcattgaagcttcggcagatctggtttaatcctagtggcggacgggtgagtaacgcgcgtgtaacctgccttatacagggggataacagtcagaaatggctgctaataccgcataagcgcacagggtcgcatgatccagtgtgaaaaactgaggtggtataagatgaaccggcgttggattagccagttggcagggtaacggcctaccaaagcgacgatccatggccggccggagggggtgaccggcaacatggggacgggcaaagggcccaaactccgacggggggcagcagtggggaatattggacaatgggggaaaccctgacgcagcgacgccgcgggaaggaaaaagtatctcggtatgtaaacttctatcagcagggaagaaaatgacggtacctgactaagaagccccggcta

SEQ ID NO: 5336 - DNA, 490 bp, Unknown
  Ascusbbf_1434823, encodes 16S rRNA
agagtttgatcctggctcaggataaacgctggcggcgcacataagacatgcaagtcgaacggacttaactcattcttaacgattgagagcggttagtggcggactggtgattaatgtataagtaacctgcctatcagatgggaaccacagttggaaacgacttctaatcccgcatatgccacgagaatcacatcgttccagtgggaaaggagcaatccgctaatagatggacttatatctgatgagctagtaggaggggtaacggcctaccaaggcgcagatcagtagccggactgagagggtaaacgaccacattgggactgagagacggacccggatcctacgggaggcagcagtcgggaagattgcgcaatggaggaaacgctgacgcagtgacggcgcgtgaaggaagaagggtttcggattgtaaacggatttagaaagggaagaaaaaagacagtaccgggagaataagcaccggctaactacg

SEQ ID NO: 5337 - DNA, 490 bp, Unknown
  Ascusbbf_1434822, encodes 16S rRNA
agagtttgatcctggctcaggatgaacgctagcggcaggcttaacacatgcaagtcgaggggcagcgcggggtagcactctcctggcggcgaccggcggaagggtgcgtaacgcgtgagcaacttgcccgtccctggaggataggcactggaaacggtgtgtaatactccataacataagttttcgcatgaagatttattgaaagattcattggtgacggatgggctcgcgagacattagctagtcggcggggtaacggcccaccgaggctacgatgtctaggggttctgagaggaaggtcacccacaacggcactgggacacggtccggactcctacgggaggcagcagtgaggaatattgggcaaggggcggaagcctgaaccagccaggccgcgtgaaggaagaaggccctatgggtcggaaacttcttttccttgggggcaataaggagcacgcgtggtccgatgagagtaccaggggaataagca

SEQ ID NO: 5338 - DNA, 488 bp, Unknown
  Ascusbbf_1324818, encodes 16S rRNA
agagtttgatcatggctcagaacgaacgctggtggcaggcttaacacatgcaagttgagcgggattaattgatagcttgctatttattatgagagcagcgcactggtgagtaacacgtgggaacatacctttttgtggtggacaacagttggaaacgactgctaataccgcataagccctaagggggaaggattaattgccgaaaggttgtcccgcggaagattaggtagtaggtggggtaacggcctacctaggcggctatctatagctgatctgagaggacgagcagccacattggaactgagacacggtccagactcctacgggaggcagcagggaggaagattgggcaatggaggaaacacggacccagctaggccgcgtgagtgaagaaggttttcggattgtaaagctctgtaagacgggaagaggatgacggtaccgtaagaagaagcaccggctaacttcgtgccagcagccgcggtaat

SEQ ID NO: 5339 - DNA, 490 bp, Unknown
  Ascusbbf_1341045, encodes 16S rRNA
agagtttgatcctggctcaggatgaacgctagcggcaggcttaacacatgcaagtcgaggggtaacgcggggtagcactactcttgcgacgaccggcgcacgggtgcgtaacgcgtatgcaacctccctgtaaccgggttatcacggagataaatttccactaatcccccatattgttattctttcgcatgttaggataacgaaagcttcttttgttacggatgggcatgcgtgacattagctagtttatacggtaacggcttaccaaggcgacgattggtaggggagctgagaggcttatcaccaacactggtactgagacagggaccagactcctacgggaggcagcagtgaggaatattggtcaatggacggaagtctgaaccagccatgccgcgtggaggaagaaggtcctatgggttgtaaactccttttggtcgagagtaataagaggcttgcgagcctcgatgagagtatcggacgaataagc

SEQ ID NO: 5340 - DNA, 490 bp, Unknown
  Ascusbbf_1342317, encodes 16S rRNA
agagtttgatcctggctcaggataaacgctggcggcgcacataagacatgcaagtcgaacggacttaactcattcttaacgcttgctagcggttagtggcggactggttagtaatgtataattaacctgcctatccgaggggaacaacagttggaaacgcctgctaataccgcatattccccgataatcacatggttcaagtgggcaaggatcactccgctgatagatggacgtatatctgattagctatttggtggggtaaaggcctaccaaggcgacgatcagtagccggactgagaggtgaaaaggccacattgggactgagagacggcccagactcctacgggaggcagcagtcgggaatattgcgcaagggaggaaactctgacgcagtgacgccgcgtgcaggaagaaggttttcggagtgtaaaatgctttagacagggaagaaaaaagacagtacctgtagaataagctccggctaactacg

SEQ ID NO: 5341 - DNA, 490 bp, Unknown
  Ascusbbf_1372519, encodes 16S rRNA
agagtttgatcctggctcaggatgaacgctagcggcaggcttaacacatgcaagtcgaggggcagcgcggggtagcactactctggctgctaccggcggaagggtgcgtaacgcgtgagcaacttgcccttccctgggtgataggcactggcaacggtgtgtaatactccatcacatatggattcacatggattcatattgaaagattcgttgttgacggattggctcgcgtaacattagctagtcggcgtggtaacggcccaccgaggctacgatgtttaggtgttctgagaggaaggtcacccacactggaacggagacacggtacagactcctacgggaggcagcagtgaggaatagtggtaaatgggaggaagcctgaaccagccatgcagcgtgaaggaataaggccctatgggtcgtaaactgcttttccttgagggcaataaggggcacgtgtggcccgatgagagtatcaggggaataagca

SEQ ID NO: 5342 - DNA, 490 bp, Unknown
  Ascusbbf_1435485, encodes 16S rRNA
agagtttgatcatggctcaggatgaacgctggcggcgtgcttaacacatgcaagtcgaacggagttatctcgctgaggagagcttgctcaaatcttgagataacttagtggcggacgggtgagtaacgcgtggataacctgccttataccgggggataacacttagaaataggtgctaataccgcataagcgcacgatctcgcatgggaaagtgtgaaaaaccccggtggtataagatggatccgcgtctgactagatagttggtgaggtaacggcccacaaagtcaacgatcagtagccggccagacagggtgaacggccagaatgggactgagacacgacccagacgcctgcgggatgcggcaatggggaaaattgcacaatgggcgagaccctgatacggcgacgccgcgtgggtgaagaaatatttcggtatgtaaagctctatcagcaaggaagaaaaaaatgacggtacttgactaagaagccc

SEQ ID NO: 5343 - DNA, 490 bp, Unknown
  Ascusbbf_1435453, encodes 16S rRNA
agagtttgatcctggctcaggatgaacgctggcggcgtgcttaacacatgcaagtcgaacggagttatctcgctgaggagagcttgctcaaatcttgagataacttagtggcggacgggtgagtaacgcgtggataacctgccttataccgggggataacacttagaaataggtgctactaccgcataagcgcacgatcccgcatgggaaagtgtgaaaaactccggtggtataagatggatccgcgtctgattagatagttggtgaggtaacggcccaccaagtcaacgatcagtagccggactgagaggagtaaaggccacatagggactgagacacggcccaaacgcctacgggaggaagcagtggggactattgcaaaatgggggaaaccctggtgcaacgacgccgcgtgagagaagaagtatgtcggtatgtaaagctctatcagcaaggaagaaaaaaatgagggtacatgacgaagaagccc

SEQ ID NO: 5344 - DNA, 487 bp, Unknown
  Ascusbbf_1324463, encodes 16S rRNA
agagtttgatcctggctcaaaacgaacgctggcggcaggcttaacacatgcaagtcgagcgggagtgagggagagcttgctattgatcatgagagcagcgcacgggtgagaaacacgtgggaacataccttgtggggggggacaacaggcggaaacgactgcgaataccgcataagccctgagggggaaagattaattgccgagagattggcccgcggaagattaggtagtaggtggggtaacggcctacctagccgacgatctatagctggtctgagaggacgatcagccacattggaacggagacacggtccagactcctacgggaggcagcagtgaggaatagtgggcaatggagggaactctgacccagccatgccgcgtgagtgaagaaggttttcggattgtaaagctctttcagacgggaagatgaggacggtaccgtcagaagaagcaccggctaacttcgtgccagcagccgcggtat

SEQ ID NO: 5345 - DNA, 490 bp, Unknown
  Ascusbbf_1373179, encodes 16S rRNA
agagtttgatcctggctcaggatgaacgctagctacaggcttaacacatgcaagtcgaggggcagcattaaagtttgcttgcaaactttagatggcgaccggcgcacgggtgagtaacacgtatccagcctgccgataactcggggatagcctttcgaaagaaagattaatacccgatggcatatttttaccgcatggtgaaactattaaagaatttcggttattgatggggatgcgttccattaggcagttggtgaggtaacggctcaccaaactttcgatggataggggttctgagaggaacgtcacgcacaatggagctgagacaaggtccaaactctgacgggaggaagcagtgaggaatattggtccatgggcgcgagcctgaaccagccaagtagcgtgaaggatgacggcccgatgggttgtaaacttcttttatatgggaataaagtttggtatgcataccattttgtatgtaccatatgaa

SEQ ID NO: 5346 - DNA, 490 bp, Unknown
  Ascusbbf_1435457, encodes 16S rRNA
agagtttgatcctggctcaggatgaacgctggcggcgtgcttaacacatgcaagtcgaacggagttatctcgctgaggagcgcttgctcacatcttgagataacttagtggcggacgggtgagtaacgcgcggataacctgccttataccgggggataacacttagaaataggtgctaataccgcataagcgcacgatcccgcatgggaaagtgtgaaaaaatccggtggtatacgatggatccgcgtgtgattagatagttggtgaggtaacggccaaccaagtcaacgatcagtagccggccagagaggtgtaacggacacattggaactgagacacgggccaaacgcctacgggaggcagcagtggggaatagtgcacaatgggggaaacccggatgcagcgacgccgcgtgagtgaagaagtatttcggtatgtaaagctctatcagcaaggaagaaaaaaatgacggtacttgactaagaagccc

SEQ ID NO: 5347 - DNA, 490 bp, Unknown
  Ascusbbf_1324806, encodes 16S rRNA
agagtttgatcctggctcaggatgaacgctagctacaggcttaacacatgcaagtcgaggggcagcattaaagtttgcttgcaaactttagatggcgaccggcgcacgggtgagtaacacgtatccagcctgccgataactcggggatagcctttcgaaagaaagattaatacccgatggcatatttttaccgcatggtgaaactattaaagaatttcggttattgatggggatgcgttccattaggcagttggtgaggtaacggctcaccaaactttcgatggataggggttctgagaggtggggacccatgatgggatgagagaaacggaccaaactcctacgggaggcagcagtgaggaagatgggtcaatgggcgcgagcgtgaaccagacaagtagcgtgaaggatgacggccctatgggttgtaaacttcttttatatgggaataaagtttggtaggcataccatgttgtatgtaccatatgaa

SEQ ID NO: 5348 - DNA, 488 bp, Unknown
  Ascusbbf_1324799, encodes 16S rRNA
agagtttgatcctggctcagaacgaacgctggcggcaggcttaacacatgcaagttgagcgggattgatttatcgcttgctattgatcatgagagcagcgcactggtgagtaacacgtgggaacataccttttggtgggttacaacagttggaaacgactgctaatacctcataatccctgagggggaaagattaattaccgagagattggcccgcggaagactcggtagtagtgggggtaacggcctacctagcctacgatctatagctggtctgagaggactatcagccacattggaactacgacacggtccagactcctacgggaggcggaagtgaggaatattgggcaatggagggaactctgacgcagccatgccgcgtgagtgaagaaggttttcggattgtaaagctctttcagacgggaagatgatgacggtaccgtcagaagaagcaccggctaacttcgtgccagcagccgcggtaat

SEQ ID NO: 5349 - DNA, 486 bp, Unknown
  Ascusbbf_1324798, encodes 16S rRNA
agagtttgatcctggctcagaacgaacgctggcggcaggtcttaggcacgcaagtcgaacggacgacagagtggcttgccattctgaagttagtggcgcacgagtgagtaacgcgtgggaaactgcccttccctggggaataacgtctggaaacggacgctactaccgcatacgcccgcaaggggaaagatttagcggtgattgatgtgcccgcgtaggattagcttgttggtggggtactggcctaccaaggcgatgatccctagctggtctgagaggacgatcagccatgctggaacttagacacggtccagacgcctacgggaggaagcagctaagaatattgggcaagggaggaaactctgacccagccatgccgcgggaatgaagaaggcctgcgggttggaaagttctgttagtcatgaagatgatgacagtagtgacagaaaaagcaccggctaacttcgtgccagcagccgcggtaat

SEQ ID NO: 5350 - DNA, 490 bp, Unknown
  Ascusbbf_1324805, encodes 16S rRNA
agagtttgatcatggctcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaaagtcggattaataccctatgttttccgttgaggacatctgaagtggaataaagatttatcgctaagggatggggatgcgtctgattagattgttggcggggtaacggcccaccaagccatcgatcagtaggggttctgagaggaagggcaccgacattggtacggagacaaggaacaaactccgaagagaggcagaagtgaggaagattggtaaatgggcgagagcctgaaccagccaagtcgcgggaaggatgaaggttttcggagtgtaaacttcttttattaaggacgaaaaatgacggtacttaatgaataagctccggctaactacgt

SEQ ID NO: 5351 - DNA, 490 bp, Unknown
  Ascusbbf_1372898, encodes 16S rRNA
agagtttgatcctggctcaggatgaacgctggcggcgcacataacacatgcaagtcgaacgaacttaatcgaacgtttacttttgaagcggttagtggcggactggtgagtaacgcgtaagcaatctgcctatcagaggggtataacagtgagaaatcattgctaataccgcataatctgtgagtatcccatgatacaaattgaaaaggagcaatcagctgttagatgtgcttgcgtctgattcgttagttggttgggtaacggcctacccagacgatgatcagtagccggactgagaggttaaacggccacattggaactgagatacggaccagactcctacgggaggcagcagtcgggaatattgcgaaatggaggaaaccctgacgcagtgacgccgcgtgcaggaagaaggttttcggattgtaaactgctttagatagggaagaaaaaaatgacggtacctctagaataagctccggctaactac

SEQ ID NO: 5352 - DNA, 490 bp, Unknown
  Ascusbbf_1322178, encodes 16S rRNA
agagtttgatcatggctcaggatgaacgctggcggcgtgcttaacacatgcaagtcgaacgaagcacttaatcggatttcttcggaatgaaagttttgtgactgagtggcggacgggtgagtaacgcgtgggtaacctgcctcatacagggggataacagttagaaatgactgctaataccgcataagaccacagcttcgcatgaagcaggggtaaaaactccggtggtatgagatggacccgcgtctgattaggtagttggtgaggtaacggcccaccaagccgactatcagtagccgaaccgagaaggtgaacggacaaagtgggaacaggaaaacgccccaacgccgtacggaggcaggcggtgggaataatggcacatgggggaaaccctgatgcagcgacgccgcgtgagcgatgaagtatttcggtatgtaaagctctatcagcagggaagaaaaaagacggtacctgactaagaagcaccggc

SEQ ID NO: 5353 - DNA, 490 bp, Unknown
  Ascusbbf_1341079, encodes 16S rRNA
agagtttgatcatggctcaggatgaacgctagctacaggcttaacacatgcaagtcgaggggcagcataacgaaagcttgcttttgttgatggcgaccggcgcacgggtgagtaacccgtatccaaccttccccttagtagggcaaggccggccgaaagtgggattaataccctaggttttccgttaggacaatcggaggggaaaaaaggtttaatgcctaagggtgggggatgcgtcggatcagttgtttgcgggggtaagggcccaccaagccatcgataagaaggggttctgagaggaaggtcccccacattggtactgagacacggaccaaactcctacgggaggcagcagtgaggaatattggtcaatgggcgagagcctgaaccagccaagtagcgtgcaggatgacggccctatgggttgtaaactgcttttgcatgggaataaagtgagggacgtgtccctttttgtatgtaccatgagaat

SEQ ID NO: 5354 - DNA, 490 bp, Unknown
  Ascusbbf_1372843, encodes 16S rRNA
agagtttgatcctggctcaggatgaacgctggcggcgtgcttaacacatgcaagtcgaacggagttatctcgctgaggagagcttgctcaaatcttgagataacttagtggcggacgggtgagtaacgcgtggataacctgccttataccgggggataacacttagaaataggtgctaataccgcataagcgcacgatcccgcatgggaaagtgtgaaaaactccggtggtaaaagatggatccgcgtctgatcagatagttggtgaggtaacggcccaccaagtcaacgatcagtagccgccctgagcaggtgaccgaccaaattgggactgggaaccggccccaactcctccggaaggcagaagtggcgagtattgcacaatgggggaaacccggatgcagcgacgccgcgtgagtgaagaagtatttcggtatgtaaagctctatcagcaaggaagaaaaaaatgacggtacttgactaagaagccc

SEQ ID NO: 5355 - DNA, 467 bp, Unknown
  Ascusbbf_1341105, encodes 16S rRNA
agagtttgatcctggctcagaacgaacgctggcggcaggcttaacacatgcaagtcgagcgccccgcatttggagcggcagttgggtgagtaacgaccgggaacctacccatttctacggaaccaaccatgccaacttgtgctaataccgcatacgccctccgggggatagctttagtggtgatggttgagcccgcgtggaattacgtagttgcggcggtaaaggctcagtatggctacgatcaattgctggtctgagaggatgaccagccacactgggactgagacacggcccagacgcatacgggggcaagcagtggggaagataggacaatgagcgcagtcctgatccagccaggccgggggagtgaagaaggccctagggttgtaaaactcatgcaccggtgaagataaggacggtaaccagagaagaagccccggcaaacttggggccagagccgcggtaat

SEQ ID NO: 5356 - DNA, 486 bp, Unknown
  Ascusbbf_1434914, encodes 16S rRNA
agagtttgatcctggctcagaacgaacgctggcggcaggtcttaggcatgcaagtcgaacggtcgccagagtggcttgccattctgaagttagtggcgcacgagtgagtaacgcgtgtgaaactgcccttcactgggggataacgtctggaaacggacgctaatacctcatacgcccgccaggggaaagatttatcggcgacgtatgtgcccgcgttggattagattgttgttggggtaatggcctacacaggcgatgatccatcgctggtccgagaggacgatcatccacgctggaactgagacacggtccagactcatacgggaggcagcagctaagaatagtgggcaagggaggaaactctgacccagccatgccgcgtgaatgaagaaggccttcggggtgtaaagttcttttagtcatgaagatgatgacagtagtgacagaaaaagcaccggctaacttcgtgccagcagccgcggtaat

SEQ ID NO: 5357 - DNA, 490 bp, Unknown
  Ascusbbf_1341116, encodes 16S rRNA
agagtttgatcatggctcaggacgaacgctggcggcgtgcctaacacatgcaagtcgagcggagccaatcggacaatcctttcggggcgcgcttgaggccgcttagtggcggacgggtgagtaacgcgcgagtaacctgcccataagagggggataacacagagaaatctgcgctaatacccaatattgaattagaatcgcatggttttaatttgacagatttatcgcttatggatggactcgcgtctgattagatagctggcggggcaacggcccaccaagtcgacgatcagtagccgaacgacgaggaggatcggccacatatggactggggcacggcccaggatcctacgggaggcagcagtgggggagaatgcgcaatgggggaaaccctgacgcagcaacgccgcgtgaaggaagaaggctgtcgggttgtaaacttctgttcttagggaagaagacagtgacggtacctaaggagcaagtcacg

SEQ ID NO: 5358 - DNA, 490 bp, Unknown
  Ascusbbf_1341062, encodes 16S rRNA
agagtttgatcctggctcaggatgaacgctggctgcgtgcctaacacatgcaagtcgaacggaaaggattcttcggaattctttcagtggcggacgggtgcgtaacgcgtgggtaacctgccccatacaggggaacaacagctggaaacggctgctaataccgcataagcgcacagtactgcatggtacagtgtgaaaagattttagcggtattggatggacgcgcgtctgattagctagtttggggtgtaacggcccaccaagcccacgataagtagccgaactgggggggtgaccagcaacatgggtactgagacacggcccaaacacctacgggaggcagcagtgggggatatgacacaatgggcgaaagcctgatgcagcgacgccgcgtgagtgaggaagtatttcggtacgtaaagctctatcagcagggaagaaaatgacggtacctgactaagaagccccggctaactacgtgccagcagcc

SEQ ID NO: 5359 - DNA, 490 bp, Unknown
  Ascusbbf_1341127, encodes 16S rRNA
agagttgatcatggctcaggatgaacgctggcggcgtgcttaacacatgcaagtcgaacggagttatctcgctgaggagagcttgctcaaatcttgagataacttagtggcggacgggtgagtaacgcgtggataacctgccttataccgggggataacacttagaaataggtgctaataccgcataagcgcacgatcccgcatgggaaagtgtgaaaaactccggtggtataagatggatccgcgtctgattagatagttggtgaggtaacggcccaccaagtcaacgatcagtagccggactgagagggggaacagccacattgggactgggaaacgggcccaaatcctacggggggcagcaatggggaataattcacaatggggggaaacccggaggagggaaggcgcgggaggggagaaataattccggtagtaaaggtctaacaacaaggaaagaaaaaaatgacggtacttgactaagaagccc

SEQ ID NO: 5360 - DNA, 488 bp, Unknown
  Ascusbbf_1324653, encodes 16S rRNA
agagtttgatcatggctcagaacgaacgctggcggcaggcttaacacatgcaagttgagcgggattaattgatagcttgctattaattatgagatcagcgcactggttagtaacacgtgggaacataccttttggtggtggacaacagttggaaacgactgctaataccgcataatccctaaggggtaaatattaattgccgaaagattggcccgcggaagattaggtagtaggtgtggtaacggcctacctagccgacgatctatagctggtctgagagtactatcagccacattggaacggagaaagggtccagactcctacgggaggcagcagtgaggaatattgggcaatggaggcaacgctgacccagacatgccgcgggagtgaagaaggttttcggattgtaaagctttttcagacgggaagatgatgacggtaccgtcagaagaagcaccggctaacttcgtgccagcagccgcggtaat

SEQ ID NO: 5361 - DNA, 490 bp, Unknown
  Ascusbbf_1373276, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaaagtcggcttaataccctatgttttccgttgaggacatctgaagtggaataaagatttatcgctaagggatggggatgcgtctgattatgttgttggcggggtcacggcccaccaagccatcgatcagtaggggttctgagaggacggtctcgcacatgggtacggtgagacagaccaaaatccgaaggggggcagcagtgaggaagattggtcaaggggcgagtgcctgaaccagccaagtagcgtgcaggaggacggccgtatgggttgtaaactgcttttgcatgggaataaagtgagggacgtggccctttttgtctgtaccatgagaat

SEQ ID NO: 5362 - DNA, 490 bp, Unknown
  Ascusbbf_1340989, encodes 16S rRNA
agagtttgatcctggctcaggatgaacgctagcggcaggcttaacacatgcaagtcgaggggcagcgcggggtagcaatactctggcggcgaccggcggaagggtgcgtaacgcgtgagcaacttgcccgtcactgggggataggcactggaaacggtgtgtaatactccataacatatggattcacatggattcatattgaaagattcgttggtgacggatgggctcgcgtaacattagctagtcggcggggtaacggcccaccgaggctacgatgtttaggggttctgagaggaaggtcacgcgctgtggagatgagaagcggtccaggctccgacggaaggcagcagtgaggaatattggtcaatggacggaagcctgaaccagccatgccgcgtgcaggaataaggccctatgggtcgtaaactgcttttccttgagagaaataagggtcacgtgtggtccgatgagagtatcaggggaataagca

SEQ ID NO: 5363 - DNA, 490 bp, Unknown
  Ascusbbf_1324670, encodes 16S rRNA
agagtttgatcctggctcagaacgaacgctggcggcaggcttaacacatgcaagttggacgggaatcgattgatagcttgctattgattgaggagagtagcgcacgggtgagtaacacgtgggaacataccttatagtgggggataacaattggaaacgattgataataccgcataagtcctaagggagaaaggagtaattcgctataagattggcccgcggaagattaggcagttggtggggtaaaggcctaccacacctacgctctatagctggtctgagaggacgataagccacattggtactacgacacggcccaatgagcaacagtgggcagcagtgaggaatattgggcaacggagtcaaccctgacacagccacgccgcgggagtgaagaaggttttcgacgtgtaaagcgcgttcggaggtgaagatgatgaaggtagcatctaaagaagccccggcaaacttcgtgccagcagccgcggta

SEQ ID NO: 5364 - DNA, 490 bp, Unknown
  Ascusbbf_1324756, encodes 16S rRNA
agagtttgatcctggctcagggtgaacgctagcggcaggcttaacacatgcaagtcgaggggcagcgcggggtagcaatactctgtcggcgaccggcgcacgggtgcgtaacgcgtgagcaacttgcccgtcactgggggttaggcactggcaacggtgtgtaataccccataatatatggattcacatggattcatattgaaagattcgttggtgacggatgggctcgcgtaacattggctattctgcggggtaacggcccaccgaggctacgatgtttagtggttctgcgaggaaaggcccccacactggaactgagacacggtccagactcctacgggaggcagcagtgaggaatattggtcaatgggcggaagcctgaaccagccatgcagcgtgcaggaataaggccctatgggtcgtaaactgcttttccttgagggcaataagggtcacgtgtggcccgatgagagtatcaggggaataagca

SEQ ID NO: 5365 - DNA, 490 bp, Unknown
  Ascusbbf_1324754, encodes 16S rRNA
agagtttgatcatggctcaggataaacgctggcggcgcacataagacatgcaagtcgaacggccttaactcattcttcacgattgagagcggttagtggcggaccggtgagtaatgtataagtaacctgcctatcagaggggaacaacagttggaaacgactgctaataccgcatatgccacgagaatcacatggttcaagtgggaaaggagcaatccgctgatagatggacttatatctgattagctagttggtggggtaacggcctaccaaggcgacgatcagtagccggactgagaggtgaaacggccacaatgggactgagatacggaccagactccgacgggaagaagcagtcggggatattgcgcaatggaggaaactctgacgcagtgacgccgagggcaggaagaaggttttcggattgtaaactgctttagaaagggaagaaaaaagacagtaccgggagaataagctccggctaactacg

SEQ ID NO: 5366 - DNA, 490 bp, Unknown
  Ascusbbf_1324752, encodes 16S rRNA
agagtttgatcctggctcaggatgaacgctagcggcaggcttaacacatgcaagtcgaggggcagcgcggggtagcaatactctggcggcgaccggcggaagggggcgtaacgcgtgagcaacaggcccgtggcagggggataagcgagggatacggcggctaagaccccgtaacaacagacctcgcatggggtgtgtttgaaagcttcggcggccacggattggctcgcgtcccattaggcagttggcggggtaacggcccaccaaaccgacgatggggagggggtctgcgaggcaggtacaacacactggaacggagtctcgctccatactactacgggcggcagccgtgcggactattggtccctgggcggcagcctgccccagccctgccgcgtgcaggaataaggccctacgggtcgtaaactgcttttgtacgggagcaatccgggtcacgagtggcctgctgagcgtaccgtacgaataagca

SEQ ID NO: 5367 - DNA, 485 bp, Unknown
  Ascusbbf_1340983, encodes 16S rRNA
agagtttgatcgggagcagaacgaacgagggcggcagggcttaggcaggaaagtcgaacggacgacagagtggcgggccattctgaagttaggggcgcacgagggaggaacgcgggggaaacggcccttcactggggaagaaaggcgggaaacggacgctaataccgcagacgcccgcaaggggaaagaggtatcggtgatggaggtgcccgcgttggattagctggttggtggggtaatggcctaccaaggcgatgatccatagctggtcggagaggacgatcagccacgctggaacggggccacggtccagactcctacgggaggccgccgctcagactcttgggcactggaggaacctctgcccccgccctgccgcgtgaatgaagacggccttcgggttgtaaagttcttttagtcatgaagatgatgaccgtcgtgacagaacacgccccggctaacttcgtgccagcagccgcggtaat

SEQ ID NO: 5368 - DNA, 490 bp, Unknown
  Ascusbbf_1324709, encodes 16S rRNA
agagtttgatcatggctcaggatgaacgctagctacaggcttaacacatgcaagtcgaggggcagcataacgaaagcttgcttttgttgatggcgaccggcgcacgggtgagtaacgcgtatccaaccttccccttagtagggcatagcccggcgaaagtcggattaataccctatgttatccgtcgaggacatcagaagtggattaaagatttatcgctaagggatggggatgcgtctgatgaggttgttggcggggtaacggcccaccgagccatcgatcagtaggggttctgagagtacggtcacgatcgtagggactgcgcgacggaccaaactcgtacgggaggaagcagtaaggaagattggtcaatgagcgagagcctgaaccaggcaagttgcgtgaagaatgacggcccgatgggtggtaaactgcttttgcatgggaataaagtgagggacgtggccctttttgtatgtaccatgagaat

SEQ ID NO: 5369 - DNA, 490 bp, Unknown
  Ascusbbf_915, encodes 16S rRNA
agagtttgatcctggctcaggatgaacgctagctacaggcttaacacatgcaagtcgaggggcagcatgaagtcagcttgctgactttgatggcgaccggcgcacgggtgcgtaacacgtatccaatctacccatggctcagggatagcctttcgaaagaaagattaatacctgatggtctgtgattgagacatctcgaacacagtaaagattaatcggcgatggatgaggatgcgtctgattagatagtaggcggggtaacggcccacctagtcgacgatcagtaggggttctgagaggaaggtcccccacattggaactgagacacggtccaaactcctacgggaggcagcagtgaggaatattggtcaatggacgagagtctgaaccagccaagtagcgtgaaggaagactgccctatgggttgtaaacttcttttgtttgggaataaagtgggccacgtgtggccttttgtatgtaccatacgaat

SEQ ID NO: 5370 - DNA, 490 bp, Unknown
  Ascusbbf_8941, encodes 16S rRNA
agagtttgatcctggctcaggatgaacgctagctacaggcttaacacatgcaagtcgaggggcagcatgggggttgcttgcaacttccgatggcgaccggcgcacgggtgagtaacgcgtatccaaccttccccatagtaggggatagcccgtagaaatgcggattaataccctatgttctccgaagaggacatctgatttggagtaaagatttatcgctatgggatggggatgcgtctgattaggctgcaggcggggtaacggcccacctggcctacgatcagtaggggttctgagaggaaggtcccccacactggtactgagacacggaccagactcctacgggaggcagcagtgaggaatattggtcaatgggcgtaagcctgaaccagccaagtagcgtgagggatgacggccctacgggttgtaaacctcttttgttcgggaataacgtgcggcacgcgtgccgctttgcatgtaccgttcgaat

SEQ ID NO: 5371 - DNA, 490 bp, Unknown
  Ascusbbf_8480, encodes 16S rRNA
agagtttgatcatggctcaggacgaacgctggcggcgtgcttaacacatgcaagtcgaacggagtgaaggggagcttgctccttggaacttagtggcaaacgggtgagtaacgcgtaggcaacctgcccttcagatggggacaacatttcgaaaggaatgctaataccgaatgacgtgcattggtcgcatgaccgatgcaccaaaggccgggcaaccggtcactgaaggatgggcctgcgtctgattagctagttggtggggtaacggcccaccaaggcgacgatcagtagccggtctgagaggatgaacggccacattgggactgagacacggcccaaactcctacgggaggcagcagtggggaatcttccgcaatgggcgcaagcctgacggagcaacgccgcgtgagtgaagaaggttttcggatcgtaaagctctgttgtcagggacgagagacttgatcaggaaatgggtcaaggaggacggtac

SEQ ID NO: 5372 - DNA, 490 bp, Unknown
  Ascusbbf_374, encodes 16S rRNA
agagtttgatcctggctcaggatgaacgctagctacaggcttaacacatgcaagtcgaggggcagcatagcggaagcttgcttctgctgatggcgaccggcgcacgggtgagtaacgcgtatccaaccttccctacagtaggggatagcccggcgaaagtcggattaataccctatgttcttcttcgatgacatctgaggagaagcaaaggttcaccgctataggatggggatgcgtctgattagcttgttggcggggtaacggcccaccaaggctacgatcagtaggggttctgagaggaaggtcccccacattggtactgagacacggaccaaactcctacgggaggcagcagtgaggaatattggtcaatgggcgagagcctgaaccagccaagtagcgtgcaggatgactgccctatgggttgtaaactgcttttatgcgggaataaagtcgggcacgtgtgcctgtttgtatgtaccgcatgaat

SEQ ID NO: 5373 - DNA, 490 bp, Unknown
  Ascusbbf_6906, encodes 16S rRNA
agagtttgatcatggctcaggatgaacgctagctacaggcttaacacatgcaagtcgaggggcagcgaagagttagcttgctaattctgtcggcgaccggcgcacgggtgagtaacgcgtatccaaccttccccttagtagggcatagcccggcgaaagtcggattaataccctatgttgttcatcgcaggcatctaaagtgaaccaaagatttattgctaagggatggggatgcgtctgattaggttgttggcggggtaacggcccaccaagccttcgatcagtaggggttctgagaggaaggtcccccacattggaactgagacacggtccaaactcctacgggaggcagcagtgaggaatattggtcaatggacggaagtctgaaccagccaagtagcgtgcaggatgacggccctatgggttgtaaactgcttttgtcagggaataaagttaggcacgtgtgcttatttgtatgtacctgaagaat

SEQ ID NO: 5374 - DNA, 490 bp, Unknown
  Ascusbbf_721, encodes 16S rRNA
agagtttgatcatggctcaggatgaacgctagctacaggcttaacacatgcaagtcgaggggcagcatgattctagcttgctagaattgatggcgaccggcgcacgggtgagtaacgcgtatccaaccttccctatagtagaggatagcccggcgaaagtcggattaatactctatgttgttcaatgcggacatctaagttgaaccaaaggtttaccgctataggatggggatgcgtctgattagatggtaggcggggtaacggcccacctagtcgacgatcagtaggggttctgagaggaaggtcccccacattggaactgagacacggtccaaactcctacgggaggcagcagtgaggaatattggtcaatgggcgagagcctgaaccagccaagtagcgtgcaggatgacggccctatgggttgtaaactgcttttatacggggataaagtgagggacgtgtccctttttgtaggtaccgtatgaat

SEQ ID NO: 5375 - DNA, 490 bp, Unknown
  Ascusbbf_3819, encodes 16S rRNA
agagtttgatcatggctcaggatgaacgctggcggcgtgcttaacacatgcaagtcgagcgaagctcctttgttgatttcttcggattgattcaaaggatgactgagcggcggacgggtgagtaacgcgtggagaacctgccccgtaccgggggataacagttagaaatgactgctaataccgcataagcgcacactatcgcatgatagagtgtgaaaaactccggtggtacgggatggctccgcgttggattagccagttggcggggtaacggcccaccaaagcgacgatccatagccggcctgagagggcgaccggccacattgggactgagacacggcccaaactcctacgggaggcagcagtggggaatattgcacaatgggggaaaccctgatgcagcgacgccgcgtgaacgaagaagtatttcggtatgtaaagttctatcagcagggaagaaaatgacggtacctgactaagaagccccggc

SEQ ID NO: 5376 - DNA, 490 bp, Unknown
  Ascusbbf_4323, encodes 16S rRNA
agagtttgatcatggctcaggatgaacgctagctacaggcttaacacatgcaagtcgaggggcagcatgagggtagcaatacctttgatggcgaccggcgcacgggtgcgtaacacgtatccaatctacccatggctcgggaatagcctttcgaaagaaagattaatgcccgatggtctgcgattgagacatctcgattacagtaaagatttatcggcgatggatgaggatgcgtccgattaggtagtaggcggggtaacggcccacctagccgacgatcggtaggggttctgagaggaaggtcccccacattggaactgagacacggtccaaactcctacgggaggcagcagtgaggaatattggtcaatgggcgcgagcctgaaccagccaagtagcgtgagggatgactgccctatgggttgtaaacctcttttgtttgggaataaagtgtcctacgagtaggattttgtatgtacctgacgaataa

SEQ ID NO: 5377 - DNA, 490 bp, Unknown
  Ascusbbf_6087, encodes 16S rRNA
agagtttgatcatggctcaggatgaacgctagctacaggcttaacacatgcaagtcgaggggcatcaggattctagcttgctagaattgctggcgaccggcgcacgggtgagtaacgcgtatccaacctggcccttagtagaggatagcccggcgaaagtcggattaatactctatgttctccaatgcgggcatctaatttggagcaaagatttatcgctatgggatggggatgcgtctgattagcttgtcggcggggtaacggcccaccgaggcaacgatcagtaggggttctgagaggaaggtcccccacattggtactgagacacggaccaaactcctacgggaggcagcagtgaggaatattggtcaatggacgcgagtctgaaccagccaagtagcgtgcaggatgactgccctatgggttgtaaactgcttttataggggaataaagtgaggcacgtgtgcctttttgtatgtaccctatgaat

SEQ ID NO: 5378 - DNA, 490 bp, Unknown
  Ascusbbf_8414, encodes 16S rRNA
agagtttgatcatggctcaggacgaacgctggcggcgtgcttaacacatgcaagtcgtgcgaggatgtgattggaaggtcttcggaccggaagattgcatccgagcggcggacgggtgagtaacgcgtgagcaacctgccttcaacagggggataacgcatcgaaagatgtgctaataccgcgtaagaccacggcatcacatggtgcaggggtcaaaggagcaatccggttgaagatgggctcgcgtccgattagccagttggtgaggtaacggcccaccaaagcaacgatcggtagccgacctgagagggtgatcggccacattggaactgagacacggtccagactcctacgggaggcagcagtggggaatattgggcaatgggcgaaagcctgacccagcaacgccgcgtgagggaagaagggtttcggctcgtaaacctctgtcctaaagggcgaagaaaatgacggtactttaggaggaagcccc

SEQ ID NO: 5379 - DNA, 300 bp, Unknown
  Ascusbbf_6176A, encodes 16S rRNA
agagtttgatcatggctcaggatgaacgctagctacaggcttaacacatgcaagtcgaggggcagcatgatcgaagcttgctttgattgatggcgaccggcgcacgggtgagtaacgcgtatccaaccttccctatagtagaggatagcccggcgaaagtcggattaatactctatgttttccaatgcagacatctaagttggaacaaaggttcaccgctataggatggggatgcgtctgattaggttgttggcggggtaacggcccaccaagcctacgatcagtaggggttctgagagg

SEQ ID NO: 5380 - DNA, 300 bp, Unknown
  Ascusbbf_6176B, encodes 16S rRNA
agagtttgatcatggctcaggatgaacgctagctacaggcttaacacatgcaagtcgaggggcagcatgacgatagcttgctattgttgatggcgaccggcgcacgggtgagtaacgcgtatccaaccttccctatagtagaggatagcccggcgaaagtcggattaatactctatgttttccaatgcagacatctaagttggaacaaaggtttaccgctataggatggggatgcgtctgattagatagtaggcggggtaacggcccacctagtcgacgatcagtaggggttctgagagg

SEQ ID NO: 5381 - DNA, 300 bp, Unknown
  Ascusbbf_6176C, encodes 16S rRNA
agagtttgatcatggctcaggatgaacgctagctacaggcttaacacatgcaagtcgaggggcagcatgatcgaagcttgctttgattgatggcgaccggcgcacgggtgagtaacgcgtatccaaccttccctatagtagaggatagcccggcgaaagtcggattaatactctatgttttccaatgcagacatctaagttggaacaaaggttcaccgctataggatggggatgcgtctgattaggtagtcggcggggtaacggcccaccgagccaacgatcagtaggggttctgagagg

SEQ ID NO: 5382 - DNA, 300 bp, Unknown
  Ascusbbf_6176D, encodes 16S rRNA
agagtttgatcatggctcaggatgaacgctagctacaggcttaacacatgcaagtcgaggggcagcatgatctaagcttgcttagattgatggcgaccggcgcacgggtgagtaacgcgtatccaaccttccctatagtagaggatagcccggcgaaagtcggattaatactctatgttttccaatgcagacatctaagttggaacaaaggttcaccgctataggatggggatgcgtctgattagatagtaggcggggtaacggcccacctagtcgacgatcagtaggggttctgagagg

SEQ ID NO: 5383 - DNA, 300 bp, Unknown
  Ascusbbf_6176E, encodes 16S rRNA
agagtttgatcatggctcaggatgaacgctagctacaggcttaacacatgcaagtcgaggggcagcatgatctaagcttgcttagattgatggcgaccggcgcacgggtgagtaacgcgtatccaaccttccctatagtagaggatagcccggcgaaagtcggattaatactctatgttttccaatgcagacatctaagttggaacaaaggttcaccgctataggatggggatgcgtctgattagattgtaggcggggtaacggcccacctagtcgacgatcagtaggggttctgagagg

SEQ ID NO: 5384 - DNA, 301 bp, Unknown
  Ascusbbf_6176F, encodes 16S rRNA
agagtttgatcatggctcaggatgaacgctagctacaggcttaacacatgcaagtcgaggggcagcatgatcgaagcttgctttgattgatggcgaccggcgcacgggtgagtaacgcgtatccaaccttccctatagtagaggatagcccggcgaaagtcggattaatactctatgttttccaatgcagacatctaagttggaacaaaggttcaccgctataggatggggatgcgtctgattaggtagtaggcgggttaacggcccacctagccgacgatcagtaggggttctgagagga

SEQ ID NO: 5385 - DNA, 300 bp, Unknown
  Ascusbbf_6176G, encodes 16S rRNA
agagtttgatcctggctcaggatgaacgctagctacaggcttaacacatgcaagtcgaggggcagcatgatctaagcttgcttagattgatggcgaccggcgcacgggtgagtaacgcgtatccaaccttccctatagtagaggatagcccggcgaaagtcggattaatactctatgttttccaatgcagacatctaagttggaacaaaggtttaccgctataggatggggatgcgtctgattagatagtaggcggggtaacggcccacctagtcgacgatcagtaggggttctgagagg

SEQ ID NO: 5386 - DNA, 300 bp, Unknown
  Ascusbbf_6176H, encodes 16S rRNA
agagtttgatcatggctcaggatgaacgctagctacaggcttaacacatgcaagtcgaggggcagcatgatctaagcttgcttagattgatggcgaccggcgcacgggtgagtaacgcgtatccaaccttccctatagtagaggatagcccggcgaaagtcggattaatactctatgttttccaatgcagacatctaaaatggaataaaggtttaccgctataggatggggatgcgtctgattagatagtaggcggggtaacggcccacctagtcgacgatcagtaggggttctgagagg

SEQ ID NO: 5387 - DNA, 300 bp, Unknown
  Ascusbbf_6176I, encodes 16S rRNA
agagtttgatcctggctcaggatgaacgctagctacaggcttaacacatgcaagtcgaggggcagcatgatcgaagcttgctttgattgatggcgaccggcgcacgggtgagtaacgcgtatccaaccttccctatagtagaggatagcccggcgaaagtcggattaatactctatgttttccaatgcagacatctaaaatggaacaaaggtttaccgctataggatggggatgcgtctgattagatagtaggcggggtaacggcccacctagtcgacgatcagtaggggttctgagagg

SEQ ID NO: 5388 - DNA, 301 bp, Unknown
  Ascusbbf_4883A, encodes 16S rRNA
agagtttgatcctggctcaggatgaacgctagctacaggcttaacacatgcaagtcgaggggcagcatattggtagcttgctaccaatgatggcgaccggcgcacgggtgagtaacgcgtatccaaccttccccatagtagggcatagcccgtagaaatgcggattaataccctatgttttccgaagatgacatctgatttggaacaaaggttcaccgctataggatggggatgcgtctgattagcttgttggcggggtaacggcccaccaaggcgacgatcagtaggggttctgagagga

SEQ ID NO: 5389 - DNA, 300 bp, Unknown
  Ascusbbf_4883B, encodes 16S rRNA
agagtttgatcctggctcaggatgaacgctagctacaggcttaacacatgcaagtcgaggggcagtatattggtagcttgctaccaatgatggcgaccggcgcacgggtgagtaacgcgtatccaaccttccccatagtagggcatagcccgtagaaatgcggattaataccctatgttttccgaagatgacatctgatttggaacaaaggttcaccgctatgggatggggatgcgtctgattaggtagtcggcggagtaacggcccaccgagccgacgatcagtaggggttctgagagg

SEQ ID NO: 5390 - DNA, 300 bp, Unknown
  Ascusbbf_4883C, encodes 16S rRNA
agagtttgatcctggctcaggatgaacgctagctacaggcttaacacatgcaagtcgaggggcagcatattggtagcttgctaccaatgatggcgaccggcgcacgggtgagtaacgcgtatccaaccttccccatagtagggcatagcccgtagaaatgcggattaataccctatgttttccgaagatgacatctgatttggaacaaaggttcaccgctatgggatggggatgcgtctgattaggtagtcggcggggtaacggcccaccgagccgacgatcagtaggggttctgagagg

SEQ ID NO: 5391 - DNA, 301 bp, Unknown
  Ascusbbf_4883D, encodes 16S rRNA
agagtttgatcctggctcaggatgaacgctagctacaggcttaacacatgcaagtcgaggggcagcatattggtagcttgctaccaatgatggcgaccggcgcacgggtgagtaacgcgtatccaaccttccccatagtagggcatagcccgtagaaatgcggattaataccctatgttttccgaagatgacatctgatttggaacaaaggttcaccgctatgggatggggatgcgtctgattaggtagtcggcggggtaacggcccaccgagccgacggtcagtaggggttctgagagga

SEQ ID NO: 5392 - DNA, 300 bp, Unknown
  Ascusbbf_4883E, encodes 16S rRNA
agagtttgatcatggctcaggatgaacgctagctacaggcttaacacatgcaagtcgaggggcagcatattggtagcttgctaccaatgatggcgaccggcgcacgggtgagtaacgcgtatccaaccttccccatagtagggcatagcccgtagaaatgcggattaataccctatgttttccgaagatgacatctgatttggaacaaaggttcaccgctatgggatggggatgcgtctgattaggtagtcggcggggtaacggcccaccgagccgacgatcagtaggggttctgagagg

SEQ ID NO: 5393 - DNA, 300 bp, Unknown
  Ascusbbf_13543A, encodes 16S rRNA
agagtttgatcatggctcaggacgaacgctggcggcgtgcttaacacatgcaagtcgaacggggcaattaaaagcttgcttttgaaagcctagtggcaaacgggtgagtaacgcgtaggcaacctacccttgggatggggacaacaggacgaaagccctgctaataccgaatgaagcatcccttccgcatggaggggatatgaaagatggcctctacttgtaagctatcacccagggatgggcctgcgtctgattagccagttggcggggtaacggcccaccaaagcgacgatcagtagc

SEQ ID NO: 5394 - DNA, 301 bp, Unknown
  Ascusbbf_13543B, encodes 16S rRNA
agagtttgatcctggctcaggacgaacgctggcggcgtgcttaacacatgcaagtcgaacgggattgattgaaagcttgcttttgagagatctagtggcaaacgggtgagtaacgcgtaggcaacctacccttgggatggggacaacaggacgaaagccctgctaataccgaatgaagcatcccttccgcatggaggggatatgaaagatggcctctacttgtaagctatcacccagggatgggcctgcgtctgattagccagttggcggggtaacggcccaccaaagcgacgatcagtag

SEQ ID NO: 5395 - DNA, 299 bp, Unknown
  Ascusbbf_13543C, encodes 16S rRNA
agagtttgatcatggctcaggacgaacgctggcggcgtgcttaacacatgcaagtcgaacggggcaatcgaaagcttgcttttgaaagcctagtggcaaacgggtgagtaacgcgtaggcaacctacccttgggatggggacaacaggacgaaagccctgctaataccgaatgaagcatcccttccgcatggaggggatatgaaagatggcctctacttgtaagctatcacccagggatgggcctgcgtctgattagccagttggcggggtaacggcccaccaaagcgacgatcagtag

SEQ ID NO: 5396 - DNA, 301 bp, Unknown
  Ascusbbf_13543D, encodes 16S rRNA
agagtttgatcctggctcaggatgaacgctggcggcgtgcctaatacatgcaagtcgagcgaaccacttcggtggtgagcggcgaacgggtgagtaacacgtaggtgatctgcccatcagacggggacaacgattggaaacgatcgctaataccggataggacgaaagtttaaaggtgcttctggcaccgctgatggatgagcctgcggcgcattagctagttggtagggtaaaggcctaccaaggcgacgatgcgtagccgacctgagagggtgaacggccacactgggactgagacacg

SEQ ID NO: 5397 - DNA, 299 bp, Unknown
  Ascusbbf_13543E, encodes 16S rRNA
agagtttgatcctggctcaggacgaacgctggcggcgtgcttaacacatgcaagtcgaacggggcaatcgaaagcttgcttttgaaagcctagtggcaaacgggtgagtaacgcgtaggcaacctacccttgggatggggacaacaggacgaaagccctgctaataccgaatgaagcatcccttccgcatggaggggatatgaaagatggcctctacttgtaagctatcacccagggatgggcctgcgtctgattagccagttggcggggtaacggcccaccaaagcgacgatcagtag

SEQ ID NO: 5398 - DNA, 300 bp, Unknown
  Ascusbbf_152A, encodes 16S rRNA
agagtttgatcctggctcaggacgaacgctggcggcgtgcttaacacatgcaagtcgaacgagaatccgtggaaagagttttcggacaatggaagcggaggaaagtggcggacgggtgagcaacgcgtgaggaacctgccttggagagggggacaacagctggaaacggctgctaataccgcatgatgcattggagtcgcatggctctgatgccaaagatttatcgctctgagatggcctcgcgtctgattagatagttggcggggtaacggcccaccaagtcgacgatcagtagccgga

SEQ ID NO: 5399 - DNA, 300 bp, Unknown
  Ascusbbf_152B, encodes 16S rRNA
agagtttgatcatggctcaggacgaacgctggcggcgtgcttaacacatgcaagtcgaacgagaatccgtggaaagagttttcggacaatggaagcggaggaaagtggcggacgggtgagtaacgcgtgaggaacctgccttggagagggggacaacagctggaaacggctgctaataccgcatgatgcattggagtcgcatggctctgatgccaaagatttatcgctctgagatggcctcgcgtctgattagatagttggcggggtaacggcccaccaagtcgacgatcagtagccgga

SEQ ID NO: 5400 - DNA, 300 bp, Unknown
  Ascusbbf_152C, encodes 16S rRNA
agagtttgatcctggctcaggacgaacgctggcggcgtgcttaacacatgcaagtcgaacgagaatccgtggaaagagttttcggacaatggaagcggaggaaagtggcggacgggtgagtaacgcgtgaggaacctgccttggagagggggacaacagctggaaacggctgctaataccgcatgatgcattggagtcgcatggctctgatgccaaagatttatcgctctgagatggcctcgcgtctgattagatagttggcggggtaacggcccaccaagtcgacgatcagtagccgga

SEQ ID NO: 5401 - DNA, 300 bp, Unknown
  Ascusbbf_707A, encodes 16S rRNA
agagtttgatcctggctcaggatgaacgctagctacaggcttaacacatgcaagtcgaggggcagcgagaggaaagcttgctttccttgtcggcgaccggcgcacgggtgagtaacgcgtatccaaccttccccttagtagggcatagcccggcgaaagtcggattaataccctatgttttccgatgaggacatctgagctggaacaaagatttatcgctaagggatggggatgcgtctgattaggtagtcggcggggtaacggcccaccgagcctacgatcagtaggggttctgagagg

SEQ ID NO: 5402 - DNA, 300 bp, Unknown
  Ascusbbf_707B, encodes 16S rRNA
agagtttgatcatggctcaggatgaacgctagctacaggcttaacacatgcaagtcgaggggcagcgagaggaaagcttgctttccttgtcggcgaccggcgcacgggtgagtaacgcgtatccaaccttccccttagtagggcatagcccggcgaaagtcggattaataccctatgttttccgatgaggacatctgagctggaacaaagatttatcgctaagggatggggatgcgtctgattaggtagtcggcggggtaacggcccaccgagcctacgatcagtaggggttctgagagg

SEQ ID NO: 5403 - DNA, 301 bp, Unknown
  Ascusbbf_707C, encodes 16S rRNA
agagtttgatcatggctcaggatgaacgctagctacaggcttaacacatgcaagtcgaggggcagcgagagggaagcttgctttccttgtcggcgaccggcgcacgggtgagtaacgcgtatccaaccttccccttagtagggcatagcccggcgaaagtcggattaataccctatgttttccgatgaggacatctgagctggaacaaagatttatcgctaagggatggggatgcgtctgattaggttgttggcggggtaacggcccaccaagcctgcgatcagtaggggttctgagagga

SEQ ID NO: 5404 - DNA, 300 bp, Unknown
  Ascusbbf_707D, encodes 16S rRNA
agagtttgatcctggctcaggatgaacgctagctacaggcttaacacatgcaagtcgaggggcagcgagaagaaagcttgctttctttgtcggcgaccggcgcacgggtgagtaacgcgtatccaaccttccccttagtagggcatagcccggcgaaagtcggattaataccctatgttttccaatgaggacatctgagctggaacaaagatttatcgctaagggatggggatgcgtctgattaggtagtcggcggggtaacggcccaccgagcctgcgatcagtaggggttctgagagg

SEQ ID NO: 5405 - DNA, 300 bp, Unknown
  Ascusbbf_707E, encodes 16S rRNA
agagtttgatcctggctcaggatgaacgctagctacaggcttaacacatgcaagtcgaggggcatcgagaagaaagcttgctttctttgtcggcgaccggcgcacgggtgagtaacgcgtatccaaccttccccttagtagggcatagcccggcgaaagtcggattaataccctatgttttccgttgaggacatctgaagtggaacaaagattcatcgctaagggatggggatgcgtctgattaggtagtcggcggggtaacggcccaccgagccaacgatcagtaggggttctgagagg

SEQ ID NO: 5406 - DNA, 300 bp, Unknown
  Ascusbbf_707F, encodes 16S rRNA
agagtttgatcctggctcaggatgaacgctagctacaggcttaacacatgcaagtcgaggggcatcgagaggaaagcttgctttccttgtcggcgaccggcgcacgggtgagtaacgcgtatccaaccttccccttagtagggcatagcccggcgaaagtcggattaataccctatgttttccgatgaggacatctgagctggaacaaagatttatcgctaagggatggggatgcgtctgattaggttgttggcggggtaacggcccaccaagcctacgatcagtaggggttctgagagg

SEQ ID NO: 5407 - DNA, 300 bp, Unknown
  Ascusbbf_707G, encodes 16S rRNA
agagtttgatcctggctcaggatgaacgctagctacaggcttaacacatgcaagtcgaggggcatcgagaggaaagcttgctttccttgtcggcgaccggcgcacgggtgagtaacgcgtatccaaccttccccttagtagggcatagcccggcgaaagtcggattaataccctatgttttccgatgaggacatctgagctggaataaagatttatcgctaagggatggggatgcgtctgattaggtagtcggcggggtaacggcccaccgagccaacgatcagtaggggttctgagagg

SEQ ID NO: 5408 - DNA, 300 bp, Unknown
  Ascusbbf_707H, encodes 16S rRNA
agagtttgatcatggctcaggatgaacgctagctacaggcttaacacatgcaagtcgaggggcatcgagaggaaagcttgctttccttgtcggcgaccggcgcacgggtgagtaacgcgtatccaaccttccccttagtagggcatagcccggcgaaagtcggattaataccctatgttttccgatgaggacatctgagctggaacaaagatttatcgctaagggatggggatgcgtctgattaggttgttggcggggtaacggcccaccaagcctacgatcagtaggggttctgagagg

SEQ ID NO: 5409 - DNA, 300 bp, Unknown
  Ascusbbf_707I, encodes 16S rRNA
agagtttgatcctggctcaggatgaacgctagctacaggcttaacacatgcaagtcgaggggcagcgagaggaaagcttgctttccttgtcggcgaccggcgcacgggtgagtaacgcgtatccaacctggcccttagtaggggatagcccggcgaaagtcggattaataccctatgttttcctatgaggacatctgagcaggaacaaagatttatcgctaagggatggggatgcgtctgattagcttgtcggcggggtaacggcccaccgaggctacgatcagtaggggttctgagagg

SEQ ID NO: 5410 - DNA, 300 bp, Unknown
  Ascusbbf_707J, encodes 16S rRNA
agagtttgatcctggctcaggatgaacgctagctacaggcttaacacatgcaagtcgaggggcagcgagaggaaagcttgctttccttgtcggcgaccggcgcacgggtgagtaacgcgtatccaaccttccccttagtagggcatagcccggcgaaagtcggattaataccctatgttttccaatgaggacatctgagctggaacaaagatttatcgctaagggatggggatgcgtctgattaggtagtcggcggggtaacggcccaccgagcctacgatcagtaggggttctgagagg

SEQ ID NO: 5411 - DNA, 301 bp, Unknown
  Ascusbbf_1238A, encodes 16S rRNA
agagtttgatcctggctcagaacgaacgctggtggagtgtcttatacatgcaagtcgagcgaggacgtagcaatacgagccgagcggcgaatgggtgagtaacgcgtaagcaatctgccccgcattccggaacaaccgtgccaacgcgcggctaatgccgggagccgtggcggtccacatgggccgttgacgaaagatttatcgatgcgggatgagcttgcgtccgattagctagttggcggggcaacggcccaccaaggcgacgatcggtagccggcctgagagggcgatcggccacatt

SEQ ID NO: 5412 - DNA, 301 bp, Unknown
  Ascusbbf_1238B, encodes 16S rRNA
agagtttgatcctggctcagaacgaacgctggtggagtgtcttatacatgcaagtcgagcgaggacgtagcaatacgagccgagcggcgaatgggtgagtaacgcgtaagcaatctgccctgcattccggaacaaccgtgccaacgcgcggctaatgccgggagtcgtggtagtccacatggacgattgacgaaagatttatcgatgcaggatgagcttgcgtccgattagctagttggcggggtaacggcccaccaaggcgacgatcggtagccggcctgagagggcgatcggccacatt

SEQ ID NO: 5413 - DNA, 301 bp, Unknown
  Ascusbbf_1238C, encodes 16S rRNA
agagtttgatcatggctcaggacgaacgctggcggcgtgcttaacacatgcaagtcgaacgagacgatttagaagcttgcttttattgagtcgagtggcaaacgggtgagtaacgcgtagacaacctgccgcaaagatggggacaacagtccgaaaggactgctaataccgaatgttgtatctcctccgcatgaaagagatattaaagatggcctctacttgtaagctatcgctttgcgatgggtctgcgtctgattagctagttggtggggcaacggcctaccaaggcaacgatcagtag

SEQ ID NO: 5414 - DNA, 301 bp, Unknown
  Ascusbbf_1238D, encodes 16S rRNA
agagtttgatcctggctcagaacgaacgctggtggagtgtcttatacatgcaagtcgagcgaggacgtagcaatacgagccgagcggcgaatgggtgagtaacgcgtaagcaatctgccccgcattccggaacagccgtgccaacgcgcggctaatgccgggagccgtggcggtccgcatgggccgttgacgaaagatttatcgatgcgggatgagcttgcgtccgattagctagttggcggggcaacggcccaccaaggcgacgatcggtagccggcctgagagggcgatcggccacatt

SEQ ID NO: 5415 - DNA, 301 bp, Unknown
  Ascusbbf_5588A, encodes 16S rRNA
agagtttgatcctggctcaggatgaacgctagctacaggcttaacacatgcaagtcgaggggcagcatgacgagtgcttgcacttgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaagggatggcgatgcgtaggattaggtagtcggcggggtaacggcccaccgagcccacgatccttaggggttctgagaggaa

SEQ ID NO: 5416 - DNA, 300 bp, Unknown
  Ascusbbf_5588B, encodes 16S rRNA
agagtttgatcctggctcaggatgaacgctagctacaggcttaacacatgcaagtcgaggggcagcatgacgatagcttgctattgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaagggatggcgatgcgtaggattaggtagtcggcggggtaacggcccaccgagcctacgatccttaggggttctgagagga

SEQ ID NO: 5417 - DNA, 300 bp, Unknown
  Ascusbbf_5588C, encodes 16S rRNA
agagtttgatcatggctcaggatgaacgctagctacaggcttaacacatgcaagtcgaggggcagcatgacgagtgcttgcacttgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaagggatggcgatgcgtaggattaggtagtcggcggggtaacggcccaccgagcctacgatccttaggggttctgagagga

SEQ ID NO: 5418 - DNA, 301 bp, Unknown
  Ascusbbf_5588D, encodes 16S rRNA
agagtttgatcctggctcaggatgaacgctagctacaggcttaacacatgcaagtcgaggggcagcatgacgagtgcttgcacttgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaagggatggcgatgcgtaggattaggtagtcggcggggtaacggcccaccgagcctacgatccttaggggttctgagaggaa

SEQ ID NO: 5419 - DNA, 301 bp, Unknown
  Ascusbbf_5588E, encodes 16S rRNA
agatttgatcctggctcaggatgaacgctagctacaggcttaacacatgcaagtcgaggggcagcatgacgatagcttgctattgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaagggatggcgatgcgtaggattaggtagtcggcggggtaacggcccaccgagcctacgatccttaggggttctgagaggaag

SEQ ID NO: 5420 - DNA, 300 bp, Unknown
  Ascusbbf_5588F, encodes 16S rRNA
agagtttgatcatggctcaggacggacgctagctacaggattaacacatgcaagtcgaggggcagcatgacgagtgcttgcacttgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaagggatggcgatgcgtaggattaggtagtcggcggggtaacggcccaccgagcccacgatccttaggggttctgagagga

SEQ ID NO: 5421 - DNA, 300 bp, Unknown
  Ascusbbf_5588G, encodes 16S rRNA
agagtttgatcatggctcaggatgaacgctagctacaggcttaacacatgcaagtcgaggggcagcatgacgatagcttgctattgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaagggatggcgatgcgtaggattaggtagtcggcggggtaacggcccaccgagcctacgatccttaggggttctgagagga

SEQ ID NO: 5422 - DNA, 300 bp, Unknown
  Ascusbbf_5588H, encodes 16S rRNA
agagtttgatcatggctcaggatgaacgctagctacaggcttaacacatgcaagtcgaggggcagcatgacgggtgcttgcacttgttgatggcgaccggcgcacgggtgcgtaacgcgtatcgaaccttccccttactcgggaatagcccggtgaaaaccgaattaatgcccgatatatatttagatggcatcagaagagtatgaaagatttatcggtaagggatggcgatgcgtaggattaggtagtcggcggggtaacggcccaccgagccgacgatccttaggggttctgagagga

SEQ ID NO: 5423 - DNA, 301 bp, Unknown
  Ascusbbf_4691A, encodes 16S rRNA
agagtttgatcatggctcaggatgaacgctggcggcgtgcctaacacatgcaagtcgaacgaagcactttcctcggagattcgtcgaagagggatttgacttagtggcggacgggtgagtaatgtatgagcaacctgcctttcagagggggacaacagttggaaacgactgctaataccgcataatgtatcgagggggcatccctttgataccaaaggagcaatccgctgaaagatgggctcatatctgattagttagttggtggggtaacggctcaccaagactgcgatcagtagccggg

SEQ ID NO: 5424 - DNA, 301 bp, Unknown
  Ascusbbf_4691B, encodes 16S rRNA
agagtttgatcctggctcaggatgaacgctggcggcgtgcctaacacatgcaagtcgaacgaagcactttcctcggagattcgtcgaagagggatttgacttagtggcggacgggtgagtaatgtatgagcaacctgcctttcagagggggacaacagttggaaacgactgctaataccgcataatgtatcgagggggcatccctttgataccaaaggagcaatccgctgaaagatgggctcatatctgattagttagttggtggggtaacggctcaccaagactgcgatcagtagccggg

SEQ ID NO: 5425 - DNA, 301 bp, Unknown
  Ascusbbf_4691C, encodes 16S rRNA
agagtttgatcatggctcaggatgaacgctggcggcgtgcctaacacatgcaagtcgaacgaagcatcttcctcagagattcgtcgaagagggatttgacttagtggcggacgggtgagtaatgtatgagcaacctgcctttcagagggggacaacagttggaaacgactgctaataccgcataatgtatcgagggggcatccttttgataccaaaggagcaatccgctgaaagatgggctcatatctgattagttagttggtagggtaacggcctaccaagactgcgatcagtagccggg

SEQ ID NO: 5426 - DNA, 301 bp, Unknown
  Ascusbbf_9770A, encodes 16S rRNA
agagtttgatcctggctcaggatgaacgctggcggcgtgcctaatacatgcaagtcgagcgaggtagcttgctacctagcggcgaacgggtgagtaacacgtaggtaacctgcctttaagactgggatacccaggcgaaagcttggctaataccggataacaacggggatcgcatgatctccgcttgaaaggtgcgtttgcaccacttttagatggacctgcggcacattagctagttggtgagataacagcccaccaaggcgaggatgtgtagccgacctgagagggtgaccggccacaa

SEQ ID NO: 5427 - DNA, 301 bp, Unknown
  Ascusbbf_9770B, encodes 16S rRNA
agagtttgatcatggctcaggatgaacgctggcggcgtgcctaatacatgcaagtcgagcgaggtagcttgctacctagcggcgaacgggtgagtaacacgtaggtaacctgcctttaagactgggatacccaggcgaaagcttggctaataccggataacaacggggatcgcatgatctccgcttgaaaggtgcgtttgcaccacttttagatggacctgcggcacattagctagttggtgagataacagcccaccaaggcgaggatgtgtagccgacctgagagggtgaccggccacaa

SEQ ID NO: 5428 - DNA, 301 bp, Unknown
  Ascusbbf_9770C, encodes 16S rRNA
agagtttgatcatggctcaggatgaacgctggcggcgtgcctaatacatgcaagtcgagcgaggtagcttgctacctagcggcgaacgggtgagtaacacgtaggtaacctgcctttgagactgggatacccgagggaaacttcggctaataccggataacaacggggatggcatcatctccgcttgaaaggtgcgtttgcaccactcttagatggacctgcggcacattagctagttggtgagataatagcccaccaaggcgaggatgtgtagccgacctgagagggtaaacggccacaa

SEQ ID NO: 5429 - DNA, 301 bp, Unknown
  Ascusbbf_9770D, encodes 16S rRNA
agagtttgatcatggctcaggatgaacgctggcggcgtgcctaatacatgcaagtcgagcgaggtagcttgctacctagcggcgaacgggtgagtaacacgtaggtaacctgcctttgagactgggatacccgagggaaacttcggctaataccggataacaacggggatggcatcatctccgcttgaaaggtgcgtttgcaccactcttagatggacctgcggcacattagctagttggtgagataacagcccaccaaggcgaggatgtgtagccgacctgagagggtaaacggccacaa

SEQ ID NO: 5430 - DNA, 301 bp, Unknown
  Ascusbbf_9770E, encodes 16S rRNA
agagtttgatcctggctcaggatgaacgctggcggcgtgcctaatacatgcaagtcgagcgaggtagcttgctacctagcggcgaacgggtgagtaacacgtaggtaacctgcctttaagactgggatacccgagggaaacttcggctaataccggataacaacggggatggcatcatctccgcttgaaaggtgcgtttgcaccacttttagatggacctgcggcacattagctagttggtgagataacagcccaccaaggcgaggatgtgtagccgacctgagagggtgaccggccacaa

SEQ ID NO: 5431 - DNA, 301 bp, Unknown
  Ascusbbf_9770F, encodes 16S rRNA
agagtttgatcctggctcaggatgaacgctggcggcgtgcctaatacatgcaagtcgagcgaggtagcttgctacctagcggcgaacgggtgagtaacacgtaggtaacctgcctttgagactgggatacccgagggaaacttcggctaataccggataacaacggggatggcatcatctccgcttgaaaggtgcgtttgcaccactcttagatggacctgcggcacattagctagttggtgagataatagcccaccaaggcgaggatgtgtagccgacctgagagggtaaacggccacaa

SEQ ID NO: 5432 - DNA, 301 bp, Unknown
  Ascusbbf_9770G, encodes 16S rRNA
agagtttgatcatggctcaggatgaacgctggcggcgtgcctaatacatgcaagtcgagcgaggtagcttgctacctagcggcgaacgggtgagtaacacgtaggtaacctgcctttaagactgggatacccgagggaaacttcggctaataccggataacaacggggatggcatcatctccgcttgaaaggtgcgtttgcaccacttttagatggacctgcggcacattagctagttggtgagataacagcccaccaaggcgaggatgtgtagccgacctgagagggtgaccggccacaa

SEQ ID NO: 5433 - DNA, 301 bp, Unknown
  Ascusbbf_9770H, encodes 16S rRNA
agagtttgatcctggctcaggatgaacgctggcggcgtgcctaatacatgcaagtcgagcgaggtagcttgctacctagcggcgaacgggtgagtaacacgtaggtaacctgcctttgagactgggatacccgaaggaaacttcggctaataccggataacaacggggatggcatcatctccgcttgaaaggtgcgtttgcaccactcttagatggacctgcggcacattagctagttggtgagataatagcccaccaaggcgaggatgtgtagccgacctgagagggtaaacggccacaa

SEQ ID NO: 5434 - DNA, 301 bp, Unknown
  Ascusbbf_14146A, encodes 16S rRNA
agagtttgatcctggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagagg

SEQ ID NO: 5435 - DNA, 301 bp, Unknown
  Ascusbbf_14146B, encodes 16S rRNA
agagtttgatcatggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagagg

SEQ ID NO: 5436 - DNA, 301 bp, Unknown
  Ascusbbf_14146C, encodes 16S rRNA
agagtttgatcctggctcagattgaacgctggcggcaggcctaacacatgcaagtcgaggggcagcattttagtttgcttgcaaactaaagatggcgaccggcgcacgggtgagtaatacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagactacgatggataggggttctgagagg

SEQ ID NO: 5437 - DNA, 301 bp, Unknown
  Ascusbbf_14146D, encodes 16S rRNA
agagtttgatcatggctcaggatgaacgctagctacaggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatggtatattaaaaccgcatggttttactattaaagaatttcggttatcgatggggatgcgttccattagtttgttggcggggtaacggcccaccaagactacgatggataggggttctgagagg

SEQ ID NO: 5438 - DNA, 301 bp, Unknown
  Ascusbbf_14146E, encodes 16S rRNA
agagtttgatcatggctcagtttgaacgctggcggcaggcctaacacatgcaagtcgaggggcagcattttagtttgcttgcaaactaaagatggcgaccggcgcacgggtgagtaacacgtatccaacctgccgataactcggggatagcctttcgaaagaaagattaatatccgatggtatattaaaaccgcatggttttactattaaagaatttcggttatcgatggggatgcgttccattagtttgttggcggggtaacggcccaccaagactacgatggataggggttctgagagg

SEQ ID NO: 5439 - DNA, 301 bp, Unknown
  Ascusbbf_14146F, encodes 16S rRNA
agagtttgatcatggctcaggatgaacgctgacagaatgctttacacatgcaagtcgaggggcagcattttagtttgcttgcaaactaaagatggcgaccggcgcacgggtgagtaacacgtatccaacctgccgataactcggggatagcctttcgaaagaaagattaatatccgatagtatattaaaaccgcatggttttactattaaagaatttcggttatcgatggggatgcgttccattagtttgttggcggggtaacggcccaccaagacaacgatggataggggttctgagagg

SEQ ID NO: 5440 - DNA, 301 bp, Unknown
  Ascusbbf_14146G, encodes 16S rRNA
agagtttgatcatggctcaggatgaacgctagctataggcttaacacatgcaagtcgaggggcagcattttagtttgcttgcaaactaaagatggcgaccggcgcacgggtgagtaacacgtatccaacctgccgataactcggggatagcctttcgaaagaaagattaatatccgatggtatattaaaaccgcatggttttactattaaagaatttcggttatcgatggggatgcgttccattagtttgttggcggggtaacggcccaccaagactacgatggataggggttctgagagg

SEQ ID NO: 5441 - DNA, 300 bp, Unknown
  Ascusbbf_1103A, encodes 16S rRNA
agagtttgatcatggctcaggatgaacgctggcggcgtgcttaacacatgcaagtcgaacggagtattgagaatgaagttttcggatggatttttcaatacttagtggcggacgggtgagtaacgcgtgggtaacctgcctcacacagggggataacagttggaaacgactgttaataccgcataagaccacagtaccgcatggtacaggggtaaaaactccggtggtgtgagatggacccgcgtctgattagttagttggcggggtaacggcccaccaagacgacgatcagtagccgat

SEQ ID NO: 5442 - DNA, 298 bp, Unknown
  Ascusbbf_1103B, encodes 16S rRNA
agagtttgatcctggctcaggatgaacgctggcggcgtgcttaacacatgcaagtcgaacggagtactgagaatgaagttttcggatggatttttcagtacttagtggcggacgggtgagtaacgcgtgggtaacctgcctcacacagggggataacagttggaaacgactgttaataccgcataagaccacagtaccgcatggtacaggggtaaaaactccggtggtgtgagatggacccgcgtctgattagttagttggcggggtaacggcccaccaagacgacgatcagtagccg

SEQ ID NO: 5443 - DNA, 300 bp, Unknown
  Ascusbbf_1103C, encodes 16S rRNA
agagtttgatcatggctcaggatgaacgctagctacaggcttaacacatgcaagtcgaggggcagcatgatcttagcttgctaagattgatggcgaccggcgcacgggtgagtaacgcgtatccaaccttccctgtactaggggatagcccggcgaaagtcggattaataccctatgttttccgaagcgagcatttaatttggaacaaaggtttaccggtataggatggggatgcgtctgattagatagtaggcggggtaacggcccacctagtcgacgatcagtaggggttctgagagg

SEQ ID NO: 5444 - DNA, 298 bp, Unknown
  Ascusbbf_1103D, encodes 16S rRNA
agagtttgatcatggctcaggatgaacgctggcggcgtgcttaacacatgcaagtcgaacggagtactgagaatgaagttttcggatggatttttcaatacttagtggcggacgggtgagtaacgcgtgggtaacctgcctcacacagggggataacagttggaaacgactgttaataccgcataagaccacagtaccgcatggtacaggggtaaaaactccggtggtgtgagatggacccgcgtctgattagttagttggcggggtaacggcccaccaagacgacgatcagtagccg

SEQ ID NO: 5445 - DNA, 300 bp, Unknown
  Ascusbbf_1103E, encodes 16S rRNA
agagtttgatcctggctcaggatgaacgctggcggcgtgcttaacacatgcaagtcgaacggagtattgagaatgaagttttcggatggattttttaatacttagtggcggacgggtgagtaacgcgtgggtaacctgcctcacacagggggataacagttggaaacgactgttaataccgcataagaccacagtaccgcatggtacaggggtaaaaactccggtggtgtgagatggacccgcgtctgattagttagttggcggggtaacggcccaccaagacgacgatcagtagccgat

SEQ ID NO: 5446 - DNA, 300 bp, Unknown
  Ascusbbf_1103F, encodes 16S rRNA
agagtttgatcctggctcaggatgaacgctggcggcgtgcttaacacatgcaagtcgaacggagtaataagaatgaagttttcggatggattttttattacttagtggcggacgggtgagtaacgcgtgggtaacctgcctcatacagggggataacagttggaaacgactgttaataccgcataagaccacagtgccgcatggcacaggggtaaaaactccggtggtatgagatggacccgcgtctgattagttagttggcggggtaacggcccaccaagacgacgatcagtagccgat

SEQ ID NO: 5447 - DNA, 300 bp, Unknown
  Ascusbbf_1103G, encodes 16S rRNA
agagtttgatcatggctcaggatgaacgctggcggcgtgcttaacacatgcaagtcgaacggagtattagagatgaagttttcggatggattttttaatacttagtggcggacgggtgagtaacgcgtgggtaacctgcctcatacagggggataacagttggaaacgactgttaataccgcataagaccacagtaccgcatggtacaggggtaaaaactccggtggtatgagatggacccgcgtctgattagttagttggcggggtaacggcccaccaagacgacgatcagtagccgat

SEQ ID NO: 5448 - DNA, 301 bp, Unknown
  Ascusbbf_1103H, encodes 16S rRNA
agagtttgatcatggctcaggatgaacgctagcggcaggcttaacacatgcaagtcgaggggtaacaggggatgtagcaatacatcctgctgacgaccggcgcacgggtgcgtaacgcgtatgcaacctgcccgcaacaggggtataacggagtgaaaattccactaatcccccatattgtcattaggccgcatggctttatgacgaaaggttattctggttgcggatgggcatgcgtgacattaggtagttggcggggtaacggcccaccaagccgacgatgtctaggggagctgagagg

SEQ ID NO: 5449 - DNA, 300 bp, Unknown
  Ascusbbf_1103I, encodes 16S rRNA
agagtttgatcatggctcaggatgaacgctggcggcgtgcttaacacatgcaagtcgaacggagtatcaagaatgaagttttcggatggattttttgatacttagtggcggacgggtgagtaacgcgtgggtaacctgcctcatacagggggataacagttggaaacgactgttaataccgcataagaccacagtaccgcatggtacaggggtaaaaactccggtggtatgagatggacccgcgtctgattagttagttggcggggtaacggcccaccaagacgacgatcagtagccgat

SEQ ID NO: 5450 - DNA, 300 bp, Unknown
  Ascusbbf_13717A, encodes 16S rRNA
agagtttgatcatggctcaggatgaacgctagctacaggcttaacacatgcaagtcgaggggcagcatggaggttgcttgcaacttccgatggcgaccggcgcacgggtgagtaacacgtatccaaccttccccgcggtggggaacagcccgctgaaaggcggattaatgccccatggtctcctttgcaggcatctaacgaggagtaaagattgatcgccgcgggatggggatgcgcccgattaggcagcaggcggggtgacggcccacctggccatcgatcggtaggggttctgagagg

SEQ ID NO: 5451 - DNA, 298 bp, Unknown
  Ascusbbf_13717B, encodes 16S rRNA
agagtttgatcatggctcaggacgaacgctggcggcgtgcctaacacatgcaagtcgaacggggattttgtttcggcagaatcctagtggcgaacgggtgagtaacgcgtaggcaacctgccctccggccggggacaacactccgaaaggggtgctaataccggatacgaagtctgtgccgcatggtacggatttgaaagatggcctctgtttacaagctatcgccgggggatgggcctgcgtccgattagctggttggtggggtaacggcctaccaaggcgacgatcggtagccggt

SEQ ID NO: 5452 - DNA, 300 bp, Unknown
  Ascusbbf_13717C, encodes 16S rRNA
agagtttgatcatggctcaggatgaacgctagctacaggcttaacacatgcaagtcgaggggcagcatggaggttgcttgcaacttccgatggcgaccggcgcacgggtgagtaacacgtatccaaccttccccgcggtagggaacagcccgctgaaaggcggattaatgccctatggtctcctttgcaggcatctaatgaggagtaaagattgatcgccgcgggatggggatgcgcccgattaggcagcaggcggggtgacggcccacctggccatcgatcggtaggggttctgagagg

SEQ ID NO: 5453 - DNA, 300 bp, Unknown
  Ascusbbf_876A, encodes 16S rRNA
agagtttgatcatggctcaggatgaacgctggcggcgtgcctaacacatgcaagtcgagcggagtgaagagagcttgcttttttcactcagcggcggatgggtgaggaacgcgtggggaacctgcctctcacagggggataacagctggaaacggctgttaataccgcatatgcacacagtgccgcatggcacagggtggaaagaaattcggtgagagatggacccgcgttggattagcttgttggcggggtaacggcccaccaaggcgatgatccatagccggcctgagagggcgaccg

SEQ ID NO: 5454 - DNA, 301 bp, Unknown
  Ascusbbf_876B, encodes 16S rRNA
agagtttgatcatggctcaggatgaacgctggcggcgtgcctaacacatgcaagtcgagcggagtgaagagagcttgcttttttcactcagcggcggatgggtgaggaacgcgtggggaacctacctctcacagggggataacagctggaaacggctgttaataccgcatatgcacacagtgccgcatggcacagggtggaaagaaattcggtgagagatggacccgcgttggattagcttgttggcggggtaacggcccaccaaggcgatgatccatagccggcctgagagggcgaccgg

SEQ ID NO: 5455 - DNA, 301 bp, Unknown
  Ascusbbf_876C, encodes 16S rRNA
agagtttgatcctggctcaggatgaacgctggcggcgtgcctaacacatgcaagtcgagcggagtgaagagagcttgcttttttcacttagcggcggatgggtgaggaacgcgtggggaacctgcctctcacagggggataacagctggaaacggctgttaataccgcatatgcacacagtgccgcatggcacagggtggaaagaaattcggtgagagatggacccgcgttggattagcttgttggcggggtaacggcccaccaaggcgatgatccatagccggcctgagagggcgaccgg

SEQ ID NO: 5456 - DNA, 301 bp, Unknown
  Ascusbbf_876D, encodes 16S rRNA
agagtttgatcatggctcaggatgaacgctggcggcgtgcctaacacatgcaagtcgagcggagtgaagagagcttgcttttttcacttagcggcggatgggtgaggaacgcgtggggaacctgcctctcacagggggataacagctggaaacggctgttaataccgcatatgcacacagtgccgcatggcacagggtggaaagaaattcggtgagagatggacccgcgttggattagcttgttggcggggtaacggcccaccaaggcgatgatccatagccggcctgagagggcgaccgg

SEQ ID NO: 5457 - DNA, 225 bp, Unknown
  Ascusbbf_876E, encodes 16S rRNA
agagtttgatcatggctcaggatgaacgctggcggcgtgcctaacacatgcaagtcgagcggagtgaagagagcttgcttttttcactcagcggcggatgggtgaggaacgcgtggggaacctgcctctcacagggggataacagctggaaacggctgttaataccgcatatgcacacagtgccgcatggcacagggtggaaagaaattcggtgagagatggacc

SEQ ID NO: 5458 - DNA, 301 bp, Unknown
  Ascusbbf_876F, encodes 16S rRNA
agagtttgatcatggctcaggatgaacgctggcggcgtgcctaacacatgcaagtcgagcggagtgaagagagcttgcttttttcactcagcggcggatgggtgaggaacgcgtggggaacctgcctctcacagggggataacagctggaaacggctgttaataccgcatatgcacacagtgccgcatggcacagggtggaaagaaattcggtgagagatggacccgcgttggattagcttgttggcggggtaacggcccaccaaggcgatgatccatagccggcctgagagggcgaccgg

SEQ ID NO: 5459 - DNA, 300 bp, Unknown
  Ascusbbf_876G, encodes 16S rRNA
agagtttgatcatggctcaggatgaacgctggcggcgtgcctaacacatgcaagtcgagcggagtgaagagagcttgcttttttcacttagcggcggatgggtgaggaacgcgtggggaacctgcctctcacagggggataacagctggaaacggctgttaataccgcatatgcacacagtgccgcatggcacagggtggaaagaaattcggtgagagatggacccgcgttggattagcttgttggcggggtaacggcccaccaaggcgatgatccatagccggcctgagagggcgaccg

SEQ ID NO: 5460 - DNA, 299 bp, Unknown
  Ascusbbf_4936A, encodes 16S rRNA
agagtttgatcatggctcaggacgaacgctggcggcgtgcttaacacatgcaagtcgaacggggcgattagaagcttgcttttatgagcctagtggcaaacgggtgagtaacgcgtaggcaacctgcctctaagatggggacaacagagcgaaagttctgctaataccgaatgttgtaagtaactcgcatgagggacttaccaaagatggccgctacttgtaagctatcacttagagatgggcctgcgtctgattagctagttggtggggtaacggcccaccaaggcgacgatcagtag

SEQ ID NO: 5461 - DNA, 301 bp, Unknown
  Ascusbbf_4936B, encodes 16S rRNA
agagtttgatcatggctcaggacgaacgctggcggcgtgcttaacacatgcaagtcgaacgggactgattgaaagcttgcttttgaaaagtctagtggcaaacgggtgagtaacgcgtaggcaacctgcctctaagatggggacaacagcccgaaagggctgctaataccgaatgttgtaagtaactcgcatgagagacttaccaaagatggcctctacttgtaagctatcacttagagatgggcctgcgtctgattagctagttggtgaggtaacggctcaccaaggcgacgatcagtag

SEQ ID NO: 5462 - DNA, 301 bp, Unknown
  Ascusbbf_113152A, encodes 16S rRNA
agagtttgatcctggctcaggatgaacgctggcggcgtgcttaacacatgcaagtcgaacggactttacatgaaacctagtgattgtaaagttagtggcggacgggtgagtaacgcgtgaataacctgccttgtactgggggacaacagttggaaacggctgctaataccgcataagcgcacggttccgcatggaacagtgtgaaaaactccggtggtacaagatggattcgcgtctgattagccagttggcggggtaacggcccaccaaagcgacgatcagtagccggcctgagagggtg

SEQ ID NO: 5463 - DNA, 301 bp, Unknown
  Ascusbbf_9031A, encodes 16S rRNA
agagtttgatcatggctcaggatgaacgctagctacaggcttaacacatgcaagtcgaggggcagcatggtcttagcttgctaagattgatggcgaccggcgcacgggtgagtaacgcgtatccaaccttccctatagtaggggatagcccgtagaaatgcggattaataccctatgttgtattttgaggacatctgacgaataccaaaggtttaccgctataggatggggatgcgtctgattaggttgttggtggggtaacggcccaccaagcctacgatcagtaggggttctgagagga

SEQ ID NO: 5464 - DNA, 300 bp, Unknown
  Ascusbbf_9031B, encodes 16S rRNA
agagtttgatcatggctcaggacgaacgctggcggcgtgcttaacacatgcaagtcgagcgatgaagttccttcgggaatggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcgg

SEQ ID NO: 5465 - DNA, 301 bp, Unknown
  Ascusbbf_9031C, encodes 16S rRNA
agagtttgatcatggctcaggatgaacgctagctacaggcttaacacatgcaagtcgaggggcagcatggtcttagcttgctaagattgatggcgaccggcgcacgggtgagtaacgcgtatccaaccttccctatagtaggggatagcccgtagaaatgcggattaataccctatgttgtattttgaggacatctgacgaataccaaaggtttaccgctataggatggggatgcgtctgattaggttgttggcggggtaacggcccaccaagcctacgatcagtaggggttctgagagga

SEQ ID NO: 5466 - DNA, 301 bp, Unknown
  Ascusbbf_9031D, encodes 16S rRNA
agagtttgatcctggctcaggatgaacgctagctacaggcttaacacatgcaagtcgaggggcagcatggtcttagcttgctaagattgatggcgaccggcgcacgggtgagtaacgcgtatccaaccttccctatagtaggggatagcccgtagaaatgcggattaataccctatgttgtatttcgatgacatctgacgaataccaaaggttcaccgctataggatggggatgcgtctgattaggtagtcggcggggtaacggcccaccgagccaacgatcagtaggggttctgagagga

SEQ ID NO: 5467 - DNA, 300 bp, Unknown
  Ascusbbf_9031E, encodes 16S rRNA
agagtttgatcatggctcaggatgaacgctagctacaggcttaacacatgcaagtcgaggggcagcatggtcttagcttgctaagattgatggcgaccggcgcacgggtgagtaacgcgtatccaaccttccctatagtaggggatagcccgtagaaatgcggattaataccctatgttgtatttcgatgacatctgacgaataccaaaggttcaccgctataggatggggatgcgtctgattaggtagtcggcggggtaacggcccaccgagccaacgatcagtaggggttctgagagg

SEQ ID NO: 5468 - DNA, 301 bp, Unknown
  Ascusbbf_9031F, encodes 16S rRNA
agagtttgatcatggctcaggatgaacgctagctacaggcttaacacatgcaagtcgaggggcagcatggtcttagcttgctaagattgatggcgaccggcgcacgggtgagtaacgcgtatccaaccttccctatagtaggggatagcccgtagaaatgcggattaataccctatgttgtattttgaggacatctgacgaataccaaaggttcaccgctataggatggggatgcgtctgattaggtagtcggcggggtaacggcccaccgagccaacgatcagtaggggttctgagagga

SEQ ID NO: 5469 - DNA, 301 bp, Unknown
  Ascusbbf_9031G, encodes 16S rRNA
agagtttgatcatggctcaggatgaacgctagctacaggcttaacacatgcaagtcgaggggcagcatggtcttagcttgctaaggccgatggcgaccggcgcacgggtgagtaacgcgtatccaaccttccctatagtaggggatagcccgtagaaatgcggattaataccctatgttgtattttgatgacatcagatgaataccaaaggtttaccgctataggatggggatgcgtctgattaggtagtcggcggggtaacggcccaccgagccatcgatcagtaggggttctgagagga

SEQ ID NO: 5470 - DNA, 300 bp, Unknown
  Ascusbbf_11823A, encodes 16S rRNA
agagtttgatcctggctcagaacgaatgctggcggtgcgtcttaagcatgcaagtcgaacggcaagggtagcttgctacccctagagtggcggactggtgagtaacgcgtaggtgatgtacctttcggatggggatagccagtagaaatattggataataccgaatacgatttcatatcttagaagtatgaaatgaaaagagctatggctctgccgatagaacggcctgcgtaatatcagcttgttggtgaggtaacggcccaccaaggctatgacatttatccggcctgagagggtgat

SEQ ID NO: 5471 - DNA, 300 bp, Unknown
  Ascusbbf_11823B, encodes 16S rRNA
agagtttgatcatggctcagaacgaatgctggcggtgcgtcttaagcatgcaagtcgaacggcaagggtagcttgctacccctagagtggcggactggtgagtaacgcgtaggtgatgtacctttcggatggggatagccagtagaaatattggataataccgaatacgatttcatatcttagaagtatgaaatgaaaagagctatggctctgccgatagaacggcctgcgtaatatcagcttgttggtgaggtaacggcccaccaaggctatgacatttatccggcctgagagggtgat

SEQ ID NO: 5472 - DNA, 300 bp, Unknown
  Ascusbbf_11823C, encodes 16S rRNA
agagtttgatcatggctcagaacgaatgctggcggtgcgtcttaagcatgcaagtcgaacggcaagggtagcttgctacccctagagtggcggactggtgagtaacgcgtaggtgatgtacctttcggatggggatagccagtagaaatattggataataccgaatacgatttcatatcttagaagtatgaaatgaaaagagctatggctctgccgatagaacagcctgcgtaatatcagcttgttggtgaggtaacggcccaccaaggctatgacatttatccggcctgagagggtgat

SEQ ID NO: 5473 - DNA, 300 bp, Unknown
  Ascusbbf_1007A, encodes 16S rRNA
agagtttgatcctggctcaggatgaacgctagcgacaggcttaacacatgcaagtcgaggggcagcgtggcggtagcaatactgccgacggcgaccggcgcactggtgagtaacacgtatgcaacctgcccctggttgggggataacccgcggaaacgcggcctaataccccgtatgcgccgaggccgcatgacttcggcgtgatagaatttcgtccagggatgggcatgcggcgcattagctagttggcggggcaacggcccaccaaggcaacgatgcgtaggggttctgagaggaagg

SEQ ID NO: 5474 - DNA, 301 bp, Unknown
  Ascusbbf_24422A, encodes 16S rRNA
agagtttgatcctggctcaggatgaacgctagctacaggcttaacacatgcaagtcgaggggcagcatggggatggcttgccattcccgatggcgaccggcgcacgggtgagtaacgcgtatccaacctgcccgcaaccgcggaatagcccgccgaaaggcggattaatgccgcatgagctcgcgtgagggcatctgcccgcgagcaaaggttcgttccggttgcggatggggatgcgtccgattaggcagcaggcggggcaacggcccacctggcccgcgatcggtaggggttctgagag

SEQ ID NO: 5475 - DNA, 300 bp, Unknown
  Ascusbbf_951A, encodes 16S rRNA
agagtttgatcatggctcaggatgaacgctggcggcgcgcctaacacatgcaagtcgaacggttaaagcaccttcgggtgtgtataaagtggcgaacggctgagtaacacgtgggcaacctgcccctcgcaccgggatagcctcgggaaaccgtggttaataccggatactccgggacccccgcatgggggcgccgggaaagccctgacggcgagggatgggcccgcggcctgttagcttgttggcggggtaacggcccaccaaggcgattatgggtagccgggttgagagaccgaccgg

SEQ ID NO: 5476 - DNA, 300 bp, Unknown
  Ascusbbf_951B, encodes 16S rRNA
agagtttgatcctggctcaggatgaacgctggcggcgcgcctaacacatgcaagtcgaacggttaaagcaccttcgggtgtgtataaagtggcgaacggctgagtaacacgtgggcaacctgcccctcgcaccgggatagcctcgggaaaccgtggttaataccggatactccgggacccccgcatgggggtgccgggaaagccctgacggcgagggatgggcccgcggcctgttagcttgttggcggggtaacggcccaccaaggcgattatgggtagccgggttgagagaccgaccgg

SEQ ID NO: 5477 - DNA, 300 bp, Unknown
  Ascusbbf_951C, encodes 16S rRNA
agagtttgatcctggctcaggatgaacgctggcggcgcgcctaacacatgcaagtcgaacggttaaagcaccttcgggtgtgtataaagtggcgaacggctgagtaacacgtgggcaacctgcccctcgcaccgggatagcctcgggaaaccgtggttaataccggatactccgggacccccgcatgggggtgccgggaaagccctgacggcgagggatgggcccgcggcctgttagcttgttggcgggggaacggcccaccaaggcgattatgggtagccgggttgagagaccgaccgg

SEQ ID NO: 5478 - DNA, 300 bp, Unknown; identical to SEQ ID NO: 5475
  Ascusbbf_951D, encodes 16S rRNA

SEQ ID NO: 5479 - DNA, 300 bp, Unknown
  Ascusbbf_951E, encodes 16S rRNA
agagtttgatcctggctcaggatgaacgctggcggcgcgcctaacacatgcaagtcgaacggttaaagcaccttcgggtgtgtataaagtggcgaacggctgagtaacacgtgggcaacctgcccctcgcacagggatagcctcgggaaaccgtggttaatacctgatactccgggacccccgcatgggggacccgggaaagctccgacggcgagggatgggcccgcggcctgttagcttgttggcggggtaacggcccaccaaggcaatgatgggtagccgggttgagagaccgaccgg

SEQ ID NO: 5480 - DNA, 298 bp, Unknown
  Ascusbbf_951F, encodes 16S rRNA
agagtttgatcatggctcaggacgaacgctggcggcgtgcttaacacatgcaagtcgaacgagaagagatgagaagcttgcttcttattgattcgagtggcaaacgggtgagtaacgcgtaagcaacctgcccttcagatggggacaacagctggaaacggctgctaataccgaatacgttctttttgtcgcatggcagagagaagaaagggaggctcttcggagctttcgctgaaggaggggcttgcgtctgattagctagttggaggggtaacggcccaccaaggcgacgatcagt

SEQ ID NO: 5481 - DNA, 298 bp, Unknown
  Ascusbbf_951G, encodes 16S rRNA
agagtttgatcatggctcaggacgaacgctggcggcgtgcttaacacatgcaagtcgaacgagaagagatgagaagcttgcttcttattaattcgagtggcaaacgggtgagtaacgcgtaagcaacctgcccttcagatggggacaacagctggaaacggctgctaataccgaatacgttctttttgtcgcatggcagagagaagaaagggaggctcttcggagctttcgctgaaggaggggcttgcgtctgattagctagttggaggggtaacggcccaccaaggcgacgatcagt

SEQ ID NO: 5482 - DNA, 300 bp, Unknown
  Ascusbbf_5699A, encodes 16S rRNA
agagtttgatcctggctcagaacgaacgctggcggcgcgtcttaagcatgcaagtcgagcgggattgggtagcttgctactcatgagagcggcggactggtgagtaacgcgtgggtgacgtaccctttagacggggatagctcctagaaataggaggtaataccggatacgatagtgagtgtcagaggctcattatgaaaggttcttttgaaccgctgaaggagcggcccgcgtactattagctggttggtgaggtaacggcccaccaaggcgacgatagttatccggcctgagagggtg

SEQ ID NO: 5483 - DNA, 300 bp, Unknown
  Ascusbbf_5699B, encodes 16S rRNA
agagtttgatcctggctcagaacgaacgctggcggcgcgtcttaagcatgcaagtcgagcgggattgggtagcttgctatccatgagagcggcggactggtgagtaacgcgtgggtgacgtacccttcagacggggatagctcctagaaataggaggtaataccggatacgatagtgagtgtcagaggctcattatgaaaggttcttttgaaccgctgaaggagcggcccgcgtactattagctagttggtgaggtaacggcccaccaaggcgacgatagttatccggcctgagagggtg

SEQ ID NO: 5484 - DNA, 300 bp, Unknown
  Ascusbbf_5699C, encodes 16S rRNA
agagtttgatcatggctcagaacgaacgctggcggcgcgtcttaagcatgcaagtcgagcgggattgggtagcttgctactcatgagagcggcggactggtgagtaacgcgtgggtgacgtacccttcagacggggatagctcctagaaataggaggtaataccggatacgatagtgagtgtcagaggctcattatgaaaggttcttttgaaccgctgaaggagcggcccgcgtactattagctagttggtgaggtaacggcccaccaaggcgacgatagttatccggcctgagagggtg

SEQ ID NO: 5485 - DNA, 300 bp, Unknown
  Ascusbbf_5699D, encodes 16S rRNA
agagtttgatcctggctcagaacgaacgctggcggcgcgtcttaagcatgcaagtcgagcgggattgggtagcttgctactcatgagagcggcggactggtgagtaacgcgtgggtgacgtacccttcagacggggatagctcctagaaataggaggtaataccggatacgatagtgagtgtcagaggctcattatgaaaggttcttttgaaccgctgaaggagcggcccgcgtactattagcttgttggtgaggtaacggcccaccaaggcgacgatagttatccggcctgagagggtg

SEQ ID NO: 5486 - DNA, 300 bp, Unknown
  Ascusbbf_130A, encodes 16S rRNA
agagtttgatcctggctcaggatgaacgctagctacaggcttaacacatgcaagtcgaggggcagcatgaagtttgcttgcaaactttgatggcgaccggcgcacgggtgagtaacgcgtatccaaccttccccttactagggaatagcccggcgaaagtcggattaatgccctatgttctcctttgcgggcatctaacgaggagcaaagattcatcggtaagggatggggatgcgtctgattagccagttggcggggtaacggcccaccaaggcgacgatcagtaggggttctgagagg

SEQ ID NO: 5487 - DNA, 301 bp, Unknown
  Ascusbbf_130B, encodes 16S rRNA
agagtttgatcctggctcaggatgaacgctagctacaggcttaacacatgcaagtcgaggggcagcatgaagtttgcttgcaaactttgatggcgaccggcgcacgggtgagtaacgcgtatccaaccttccccttactagggaatagcccggcgaaagtcgaattaatgccctatgttctccttcgcgggcatctaacgaggagcaaagattcatcggtaagggatggggatgcgactgattaggcagtcggcggggtaacggcccaccgagccgacgatcagtaggggttctgagagga

SEQ ID NO: 5488 - DNA, 301 bp, Unknown
  Ascusbbf_130C, encodes 16S rRNA
agagtttgatcatggctcaggatgaacgctagctacaggcttaacacatgcaagtcgaggggcagcatgaagtttgcttgcaaactttgatggcgaccggcgcacgggtgagtaacgcgtatccaaccttccccttactagggaatagcccggcgaaagtcggattaatgccctatgttctccttcgcgggcatctaacgaggagcaaagattcatcggtaagggatggggatgcgtctgattaggcagtcggcggggtaacggcccaccgagccgacgatcagtaggggttctgagagga

SEQ ID NO: 5489 - DNA, 301 bp, Unknown
  Ascusbbf_130D, encodes 16S rRNA
agagtttgatcctggctcaggatgaacgctagctacaggcttaacacatgcaagtcgaggggtaacgacagcgaaagcttgcttttgctgggcgacgaccggcgaatgggtgagtaacgcgtatccaacctgccgcaaagtagggcacagccttgcgaaagtaagattaatgccctatgtgctgtgatgatgacatcagaattgcagtaaaggttcaccgctttgcgatggggatgcgtctgattaggttgttggcggggtaacggcccaccaagcccgcgatcagtaggggttctgagag

SEQ ID NO: 5490 - DNA, 300 bp, Unknown
  Ascusbbf_130E, encodes 16S rRNA
agagtttgatcctggctcaggatgaacgctagctacaggcttaacacatgcaagtcgaggggcagcatgaagtttgcttgcaaactttgatggcgaccggcgcacgggtgagtaacgcgtatccaaccttccccttactagggaatagcccggcgaaagtcggattaatgccctatgttctccttcgcgggcatctaacgaggagcaaagattcatcggtaagggatggggatgcgtctgattaggcagtcggcggggtaacggcccaccgagccgacgatcagtaggggttctgagagg

SEQ ID NO: 5491 - DNA, 300 bp, Unknown
  Ascusbbf_130F, encodes 16S rRNA
agagtttgatcatggctcaggatgaacgctagctacaggcttaacacatgcaagtcgaggggcagcatgaagtttgcttgcaaactttgatggcgaccggcgcacgggtgagtaacgcgtatccaaccttccccttactagggaatagcccggcgaaagtcggattaatgccctatgttctcctttgcgggcatctaacgaggagcaaagattcatcggtaagggatggggatgcgtctgattagccagttggcggggtaacggcccaccaaggcgacgatcagtaggggttctgagagg

SEQ ID NO: 5492 - DNA, 301 bp, Unknown
  Ascusbbf_130G, encodes 16S rRNA
agagtttgatcctggctcaggatgaacgctagctacaggcttaacacatgcaagtcgaggggcagcatgaagtttgcttgcaaactttgatggcgaccggcgcacgggtgagtaacgtgtatccaaccttccccttactagggaatagcccggcgaaagtcggattaatgccctatgttctcctttgcgggcatctaacgaggagcaaagattcatcggtaagggatggggatgcgtctgattagccagttggcggggtaacggcccaccaaggcgacgatcggtaggggttctgagagga

SEQ ID NO: 5493 - DNA, 225 bp, Unknown
  Ascusbbf_10109A, encodes 16S rRNA
aagtttgctcctggctcaggacgcacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcgcacctccgcatggaggtgcgaggaaagatggcctctacttgtaagctatcgcc

SEQ ID NO: 5494 - DNA, 225 bp, Unknown
  Ascusbbf_10109B, encodes 16S rRNA
agagtttgatcatggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcacacttccgcatggaggtgtgaggaaagatggcctctacttgtaagctatcgc

SEQ ID NO: 5495 - DNA, 298 bp, Unknown
  Ascusbbf_10109C, encodes 16S rRNA
agagtttgatcctggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcccttctccgcatggagaagggaggaaagatggcctctacttgtaagctatcgccagaagatgggcctgcgtctgattagctagtaggtggggtaacggctcacctaggcgatgatcagtagccggt

SEQ ID NO: 5496 - DNA, 297 bp, Unknown
  Ascusbbf_10109D, encodes 16S rRNA
agagtttgatcctggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcgcacctccgcatggaggtgcgaggaaagatggcctctacttgtaagctatcgccagaagatgggcctgcgtctgattagctagtaggtggggtaacggctcacctaggcgatgatcagtagccgg

SEQ ID NO: 5497 - DNA, 298 bp, Unknown
  Ascusbbf_10109E, encodes 16S rRNA
agagtttgatcatggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcgcacctccgcatggaggtgcgaggaaagatggcctctacttgtaagctatcgccagaagatgggcctgcgtctgattagctagtaggtggggtaacggctcacctaggcgatgatcagtagccggt

SEQ ID NO: 5498 - DNA, 298 bp, Unknown
  Ascusbbf_10109F, encodes 16S rRNA
agagtttgatcctggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcacacctccgcatggaggtgtgaggaaagatggcctctacttgtaagctatcgccagaagatgggcctgcgtctgattagctagtaggcggggtaacggctcacctaggcgatgatcagtagccggt

SEQ ID NO: 5499 - DNA, 298 bp, Unknown
  Ascusbbf_10109G, encodes 16S rRNA
agagtttgatcctggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcacacttccgcatggaggtgtgaggaaagatggcctctacttgtaagctatcgccagaagatgggcctgcgtctgattagctagtaggtggggtaacggctcacctaggcgatgatcagtagccggt

SEQ ID NO: 5500 - DNA, 298 bp, Unknown
  Ascusbbf_10109H, encodes 16S rRNA
agagtttgatcatggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcacacttccgcatggaggtgtgaggaaagatggcctctacttgtaagctatcgccagaagatgggcctgcgtctgattagctagtaggtggggtaacggctcacctaggcgatgatcagtagccggt

SEQ ID NO: 5501 - DNA, 297 bp, Unknown
  Ascusbbf_10109I, encodes 16S rRNA
aagtttgatcatggctcaggacgaacgctggcggcgtgcttaacacatgcaagtcgaacggagaatttgcttcggtgaattcttagtggcgaacgggtgagtaacgcgtaggcaacctgccctctggttggggacaacattccgaaagggatgctaataccgaatgtgctcgcacctccgcatggaggtgcgaggaaagatggcctctacttgtaagctatcgccagaagatgggcctgcgtctgattagctagtaggtggggtaacggctcacctaggcgatgatcagtagccggt

SEQ ID NO: 5502 - DNA, 300 bp, Unknown
  Ascusbbf_29797A, encodes 16S rRNA
agagtttgatcatggctcaggatgaacgctagcgacaggcttaacacatgcaagtcgaggggcagcatgggaggtggcaacaccacccgatggcgaccggcgcactggtgagtaacacgtatgcaacctgccccctacaggggaataacccagagaaatttggcctaataccccgtagtcagcgagagggcatcctcctgctgggaaagctccggcggtaggggatgggcatgcggcgcattagcttgttggcggggcgacggcccaccaaggcgacgatgcgtaggggttctgagagga

SEQ ID NO: 5503 - DNA, 225 bp, Unknown
  Ascusbbf_54068A, encodes 16S rRNA
agagtttgatcatggctcaggatgaacgctggcggcgtgcctaacacatgcaagtcgaacggagtttttattgatttcttcggattgatatagaaacttagtggcggacgggtgagtaacacgtgggtaacctgccttacagagggggatagcagctggaaacggctgataataccgcataagcacacagtaccgcatggtacagggtgaaaagatttatcactg

SEQ ID NO: 5504 - DNA, 300 bp, Unknown; identical to SEQ ID NO: 5476
  Ascusbbf_54068B, encodes 16S rRNA

SEQ ID NO: 5505 - DNA, 296 bp, Unknown
  Ascusbbf_54068C, encodes 16S rRNA
agagtttgatcatggctcaggatgaacgctggcggcgtgcctaacacatgcaagtcgaacggagtttttattgatttcttcggattgatatagaaacttagtggcggacgggtgagtaacacgtgggtaacctgccttacagagggggatagcagctggaaacggctgataataccgcataagcacacagtaccgcatggtacagggtgaaaagatttatcactgtaagatggacccgcgtctgattagccagttggcagggtaacggcctaccaaagcgacgatcagtagccgac

SEQ ID NO: 5506 - DNA, 301 bp, Unknown
  Ascusbbf_54068D, encodes 16S rRNA
agagtttgatcctggctcaggatgaacgctggcggcgtgcctaacacatgcaagtcgaacggagtttttattgatttcttcggattgatatagaaacttagtggcggacgggtgagtaacacgtgggtaacctgccttacagagggggatagcagctggaaacggctgataataccgcataagcacacagtaccgcatggtacagggtgaaaagatttatcactgtaagatggacccgcgtctgattagccagttggcagggtaacggcctaccaaagcgacgatcagtagccgacctgag

SEQ ID NO: 5507 - DNA, 225 bp, Unknown
  Ascusbbf_7003A, encodes 16S rRNA
agagtttgatcatggctcaggatgaacgctggcggcgtgcctaacacatgcaagtcgaacgaggtaaatgagatgaagttttcggatggattcttatttaccgagtggcggacgggtgagtaacgcgtgggtaacctgcctcatacagggggataacgattggaaacgattgctaataccgcataagcgcacagtaccacatggtacagtgtgaaaaactccggt

SEQ ID NO: 5508 - DNA, 298 bp, Unknown; identical to SEQ ID NO: 5480
  Ascusbbf_7003C, encodes 16S rRNA

SEQ ID NO: 5509 - DNA, 301 bp, Unknown
  Ascusbbf_23A, encodes 16S rRNA
agagtttgatcctggctcaggatgaacgctggcggcgtgcttaacacatgcaagtcgaacggagaatcgcccttcgggacggttcttagtggcggacgggtgagtaacgcgtgaggaacctgccttggagtggggaataacggctggaaacggccgctaataccgcataatgcagttgggtcgcatggctctgactgccaaagatttattgctctgagatggcctcgcgtctgattagctggttggtgaggtaacggctcaccaaggcgacgatcagtagccggactgagaggttggccgg

SEQ ID NO: 5510 - DNA, 300 bp, Unknown
  Ascusbbf_1697A, encodes 16S rRNA
agagtttgatcatggctcaggatgaacgctagctacaggcttaacacatgcaagtcgaggggcagcgggaagttagcttgctaactttgccggcgaccggcgcacgggtgagtaacgcgtatccaaccttccccttagtagggcatagcccgatgaaaatcggattaataccctatgttttccaatgaggacatctgagctggaacaaagattcatcgctaagggatggggatgcgtccgattaggtagtcggcggggtaacggcccaccgagccatcgatcggtaggggttctgagagg

SEQ ID NO: 5511 - DNA, 300 bp, Unknown
  Ascusbbf_1697B, encodes 16S rRNA
agagtttgatcatggctcaggatgaacgctagctacaggcttaacacatgcaagtcgaggggcagcgggaagttagcttgctaactttgccggcgaccggcgcacgggtgagtaacgcgtatccaaccttccccttagtagggcatagcccgatgaaaatcggattaataccctatgttttccaatgaggacatctgagctggaacaaagattcatcgctaagggatggggatgcgtccgattaggtagtcggcggggtaacggcccaccgagcccgcgatcggtaggggttctgagagg

SEQ ID NO: 5512 - DNA, 301 bp, Unknown
  Ascusbbf_1697C, encodes 16S rRNA
agagtttgatcatggctcaggatgaacgctagctacaggcttaacacatgcaagtcgaggggcagcaggatcttagcttgctaagattgctggcgaccggcgcacgggtgagtaacgcgtatccaaccttccccttagtagggcatagcccgatgaaaatcggattaataccctatgttttccaatgaggacatctgagctggaacaaagattcatcgctaagggatggggatgcgtccgattaggtagtcggcggggtaacggcccaccgagccatcgatcggtaggggttctgagagga

SEQ ID NO: 5513 - DNA, 300 bp, Unknown
  Ascusbbf_7586A, encodes 16S rRNA
agagtttgatcatggctcaggatgaacgctagctacaggcttaacacatgcaagtcgaggggcagcatgaggtttgcttgcaaaccttgatggcgaccggcgcacgggtgcgcaacgcgtatccaaccttccagctactagggaatagcccgttgaaagacggattaatgccctatgtgttcattagatggcatcagatgttgaacaaagattcatcggtagctgatggggatgcgtatgattagctagtcggcggggcaacggcccaccgaggctacgatcattaggggttctgagagg

SEQ ID NO: 5514 - DNA, 300 bp, Unknown
  Ascusbbf_7586B, encodes 16S rRNA
agagtttgatcatggctcaggatgaacgctagctacaggcttaacacatgcaagtcgaggggcagcatgaggtttgcttgcaaaccttgatggcgaccggcgcacgggtgcgtaacgcgtatccaaccttccagctactagggaatagcccgttgaaagacggattaatgccctatgtgttcattagatggcatcagatgttgaacaaagattcatcggtagctgatggggatgcgtatgattagctagtcggcggggtaacggcccaccgaggctacgatcattaggggttctgagagg

SEQ ID NO: 5515 - DNA, 300 bp, Unknown
  Ascusbbf_7586C, encodes 16S rRNA
agagtttgatcctggctcaggatgaacgctagctacaggcttaacacatgcaagtcgaggggcagcatgaggtttgcttgcaaaccttgatggcgaccggcgcacgggtgcgtaacgcgtatccaaccttccagctactagggaatagcccgttgaaagacggattaatgccctatgtgttcattagatggcatcagatgttgaacaaagattcatcggtagctgatggggatgcgtatgattagctagtcggcggggtaacggcccaccgaggctacgatcattaggggttctgagagg

SEQ ID NO: 5516 - DNA, 300 bp, Unknown; identical to SEQ ID NO: 5514
  Ascusbbf_7586D, encodes 16S rRNA

SEQ ID NO: 5517 - DNA, 301 bp, Unknown
  Ascusbbf_1034A, encodes 16S rRNA
agagtttgatcatggctcaggatgaacgctggcggcgtgcctaacacatgcaagtcgaacgaagcacttctggtttgagattcgtcaagaaccgggattgacttagtggcggacgggtgagtaatgtatgagcaacctgcctttcagagggggacaacagttggaaacgactgctaataccgcataatgtatttgggtggcatcacctggataccaaaggagcaatccgctgaaagatgggctcatatctgattagttagttggcagggtaacggcctaccaagactgcgatcagtagccg

SEQ ID NO: 5518 - DNA, 301 bp, Unknown
  Ascusbbf_1034B, encodes 16S rRNA
agagtttgatcctggctcaggatgaacgctggcggcgtgcctaacacatgcaagtcgaacgaagcacttctggtttgagattcgtcaagaaccgggattgacttagtggcggacgggtgagtaatgtatgagcaacctgcctttcagagggggacaacagttggaaacgactgctaataccgcataatgtatttgggtggcatcacctggataccaaaggagcaatccgctgaaagatgggctcatatctgattagttagttggcagggtaacggcctaccaagactgcgatcagtagccg

SEQ ID NO: 5519 - DNA, 300 bp, Unknown
  Ascusbbf_23134A, encodes 16S rRNA
agagtttgatcatggctcaggatgaacgctagcggcaggcttaacacatgcaagtcgaggggcatcgcggtgtagcaatacactggcggcgaccggcggaagggtgcgtaacgcgtgagcaacatgcccgtggcagggggataatcgatggaaacgtcgtctaagaccccgtaacaagtgggatcgcatgatcctgttttgaaagcttcggcggccacggattggctcgcgtcccattaggtagtcggcggggtaacggcccaccgagccgacgatgggtaggggttctgagaggaaggt

SEQ ID NO: 5520 - DNA, 300 bp, Unknown
  Ascusbbf_43679A, encodes 16S rRNA
agagtttgatcctggctcaggatgaacgctagcggcaggcttaacacatgcaagtcgaggggcagcgcggtgtagcaatacactggcggcgaccggcgcaagggtgcgtaacgcgtgagcgacatacccgtgactggggcataaccgatggaaacgtcgcctaattccccataatacaagggaccgcatgattccttgttgaaaacttcggtggtcacggattggctcgcgtcccattagctagtcggcggggtaacggcccaccgaggcgacgatgggtaggggttctgagaggaaggt

SEQ ID NO: 5521 - DNA, 300 bp, Unknown
  Ascusbbf_43679B, encodes 16S rRNA
agagtttgatcatggctcaggatgaacgctagctacaggcttaacacatgcaagtcgaggggcagcgcggtgtagcaatacactggcggcgaccggcgcaagggtgcgtaacgcgtgagcgacatacccgtgactggggcataaccgatggaaacgtcgcctaattccccataatacaagggaccgcatggttccttgttgaaaacttcggtggtcacggattggctcgcgtcccattagctagtcggcggggtaacggcccaccgaggcgacgatgggtaggggttctgagaggaaggt

SEQ ID NO: 5522 - DNA, 299 bp, Unknown
  Ascusbbf_43679C, encodes 16S rRNA
agagtttgatcctggctcaggatgaacgctagcggcaggcttaacacatgcaagtcgaggggcagcgcggggtagcaataccctggcggcgaccggcgcaagggtgcgtaacgcgtgagcgacatacccgtgactggggcataaccgatggaaacgtcgcctaattccccataatacaagggaccgcatggttccttgttgaaaacttcggtggtcacggattggctcgcgtcccattagctagtcggcggggtaacggcccaccgaggcgacgatgggtaggggttctgagaggaagg

SEQ ID NO: 5523 - DNA, 300 bp, Unknown
  Ascusbbf_43679D, encodes 16S rRNA
agagtttgatcctggctcaggatgaacgctagcggcaggcttaacacatgcaagtcgaggggcagcgcggtgtagcaatacactggcggcgaccggcgcaagggtgcgtaacgcgtgagcgacatacccgtgactggggcataaccgatggaaacgtcgcctaattccccataatacaagggaccgcatgattccttgttgaaaacttcggtggtcacggattggctcgcgtcccattagctagtcggcggggtaacggcccaccgaggcgacgatgggtagggggtctgagaggaaggt

SEQ ID NO: 5524 - DNA, 300 bp, Unknown
  Ascusbbf_43679E, encodes 16S rRNA
agagtttgatcatggctcaggatgaacgctagcggcaggcttaacacatgcaagtcgaggggcagcgcggtgtagcaatacactggcggcgaccggcgcaagggtgcgtaacgcgtgagcgacatacccgtgactggggcataaccgatggaaacgtcgcctaattccccataatacaagggaccgcatgattccttgttgaaaacttcggtggtcacggattggctcgcgtcccattagctagtcggcggggtaacggcccaccgaggcgacgatgggtaggggttctgagaggaaggt

SEQ ID NO: 5525 - DNA, 300 bp, Unknown
  Ascusbbf_43679F, encodes 16S rRNA
agagtttgatcatggctcaggatgaacgctagcggcaggcttaacacatgcaagtcgaggggcagcgcggggtagcaatatcctggcggcgaccggcgcaagggtgcgtaacgcgtgagcgacatacccgtgactggggcataaccgatggaaacgtcgcctaattccccataacacaagggtccgcatggtcctttgttgaaaacttcggtggtcacggattggctcgcgtcccattagctagtcggcggggtaacggcccaccgaggcgacgatgggtaggggttctgagaggaaggt

SEQ ID NO: 5526 - DNA, 301 bp, Unknown
  Ascusbbf_63954A, encodes 16S rRNA
agagtttgatcatggctcaggatgaacgctagcggtaggcttaacacatgcaagtcgaggggcagcgtatcgagtagcaatacttgatgacggcgaccggcggatgggtgagtaacgcgtatgcaacctaccttgtacagggggatagacactggaaacggtgcgtaatatcccgtaatgttgtggagaggcatcttttcacaaagaaaggagtgatctggtataagatgggcatgcgtaggattagctagatggtgaggtaacggctcaccatggctacgatctttaggggttctgagag

SEQ ID NO: 5527 - DNA, 298 bp, Unknown
  Ascusbbf_1517A, encodes 16S rRNA
agagtttgatcatggctcaggacgaacgctggcggcgtgcctaacacatgcaagtcgaacggggattttgtttcggcagaatcctagtggcgaacgggtgagtaacgcgtaggcaacctgccctccggccggggacaacactccgaaaggggtgctaataccggatacgaagtctgtgccgcatggtacggatttgaaagatggcctctatttataagctatcgccgggggatgggcctgcgtccgattagctggttggtggggtaacggcctaccaaggcgacgatcggtagccggt

SEQ ID NO: 5528 - DNA, 298 bp, Unknown
  Ascusbbf_1517B, encodes 16S rRNA
agagtttgatcctggctcaggacgaacgctggcggcgtgcctaacacatgcaagtcgaacggggattttgtttcggcagaatcctagtggcgaacgggtgagtaacgcgtaggcaacctgccctccggccggggacaacactccgaaaggggtgctaataccggatacgaagtctgtgccgcatggtacggatttgaaagatggcctctatttataagctatcgccgggggatgggcctgcgtccgattagctggttggtggggtaacggcctaccaaggcgacgatcggtagccggt

SEQ ID NO: 5529 - DNA, 298 bp, Unknown; identical to SEQ ID NO: 5451
  Ascusbbf_1517C, encodes 16S rRNA

SEQ ID NO: 5530 - DNA, 298 bp, Unknown
  Ascusbbf_1517D, encodes 16S rRNA
agagtttgatcctggctcaggacgaacgctggcggcgtgcctaacacatgcaagtcgaacggggattttgtttcggcagaatcctagtggcgaacgggtgagtaacgcgtaggcaacctgccctccggccggggacaacactccgaaaggggtgctaataccggatacgaagtctgtgccgcatggtacggatttgaaagatggcctctgtttacaagctatcgccgggggatgggcctgcgtccgattagctggttggtggggtaacggcctaccaaggcgacgatcggtagccggt

SEQ ID NO: 5531 - DNA, 298 bp, Unknown
  Ascusbbf_1517E, encodes 16S rRNA
agagtttgatcatggctcaggatgaacgctggcggcgtgcctaacacatgcaagtcgaacggggattttgtttcggcagaatcctagtggcgaacgggtgagtaacgcgtaggcaacctgccctccggccggggacaacactccgaaaggggtgctaataccggatacgaagtctgtgccgcatggtacggatttgaaagatggcctctatttataagctatcgccgggggatgggcctgcgtccgattagctggttggtggggtaacggcccaccaagcctacgatcagtaggggtt

SEQ ID NO: 5532 - DNA, 298 bp, Unknown
  Ascusbbf_1517F, encodes 16S rRNA
agagtttgatcatggctcaggacgaacgctggcggcgtgcctaacacatgcaagtcgaacggggattttgtttcggcagaaccctagtggcgaacgggtgagtaacgcataggcaacctgccctccggccggggacaacactccgaaaggggtgctaataccggatacgaagtctgtgccgcatggtacggatttgaaagatggcctctatttataagctatcgccgggggatgggcctgcgtcggattagctggttggtggggtaacggcctaccaaggcgacgatcggtagccagt

SEQ ID NO: 5533 - DNA, 298 bp, Unknown
  Ascusbbf_1517G, encodes 16S rRNA
agagtttgatcctggctcaggacgaacgctggcggcgtgcctaacacatgcaagtcgaacggggattttgtttcggcagaatcctagtggcgaacgggtgagtaacgcgtaggcaacctgccctccggccggggacaacactccgaaaggggtgctaataccggatacgaagtctgtgccgcatggtacggatttgaaagatggcctctatttataagctatcgccgggggatgggcctgcgtccgattagccggttggtggggtaacggcccaccaagccgacgatcggtaggggtt

SEQ ID NO: 5534 - DNA, 297 bp, Unknown
  Ascusbbf_1517H, encodes 16S rRNA
agagtttgatcatggctcaggacgaacgctggcggcgtgcctaacacatgcaagtcgaacggggattttgttttggcagaatcctagtggcgaacgggtgagtaacgcgtaggcaacctgccctccggccggggacaacactccgaaaggggtgctaataccggatacgaagtctgtgccgcatggtacggatttgaaagatggcctctatttataagctatcgccgggggatgggcctgcgtccgattagctggttggtggggtaacggcctaccaaggcgacgatgcatagccga

SEQ ID NO: 5535 - DNA, 298 bp, Unknown
  Ascusbbf_1517I, encodes 16S rRNA
agagtttgatcctggctcaggataaacgccggcggcgtgcctaacacatgcaagtcgaacggggattttgtttcggcagaatcctagtggcgaacgggtgagtaacgcgtaggcaacctgccctccggccggggacaacactccgaaaggggtgctaataccggatacgaagtctgtgccgcatggtacggatttgaaagatggcctctgtttacaagctatcgccgggggatgggcctgcgtccgattagctggttggtggggtaacggcctaccaaggcgacgatcggtagccggt

SEQ ID NO: 5536 - DNA, 225 bp, Unknown
  Ascusbbf_104A, encodes 16S rRNA
agagtttgatcatggctcaggataaacgctggcggcgtgcctaatacatgcaagtcgaacgaggaagacccagcttgctgggttgaccgagtggcgaacgggtgagtaatacataagcaacctgcccacggagaccgggataatctctggaaacggggactaaaaccggataggcagcaatgaggcatctcaatgctgttaaaggtgagagacactggtggatgg

SEQ ID NO: 5537 - DNA, 301 bp, Unknown
  Ascusbbf_104B, encodes 16S rRNA
agagtttgatcctggctcaggataaacgctggcggcgtgcctaatacatgcaagtcgaacgagggagacccagcttgctgggttgaccgagtggcgaacgggtgagtaatacataagcaacctgcccacggagaccgggataatctctggaaacggggactaaaaccggataggcagcaatgaggcatctcaatgctgttaaaggtgagagacactggtggatgggcttatggcgcattagttagttggtgaggtaagggcccaccaagacgatgatgcgtagccggcctgagagggtgaa

SEQ ID NO: 5538 - DNA, 301 bp, Unknown
  Ascusbbf_104C, encodes 16S rRNA
agagtttgatcctggctcaggataaacgctggcggcgtgcctaatacatgcaagtcgaacgagggagacccagcttgctgggttgaccgagtggcgaacgggtgagtaatacataagcaacctgcccacggagaccgggataatctctggaaacggggactaaaaccggataggcagcaatgaggcatctcaatgctgttaaaggtgagagacactggtggatgggcttatggcgcattagttagttggtgaggtaacggcccaccaagacgatgatgcgtagccggcctgagagggtgaa

SEQ ID NO: 5539 - DNA, 300 bp, Unknown
  Ascusbbf_104D, encodes 16S rRNA
agagtttgatcatggctcgggataaacgctggcggcgtgcctaatacatgcaagtcgaacgagggagacccagcttgctgggttgaccgagtggcgaacgggtgagtaatacataagcaacctgcccacagagaccgggataatctctggaaacggggactaaaaccggataggcagcaatgaggcatctcaatgctgttaaaggtgagagacactggtggatgggcttatggcgcattagttagttggtgaggtaacggcccaccaagacgatgatgcgtagccggcctgagagggtga

SEQ ID NO: 5540 - DNA, 300 bp, Unknown
  Ascusbbf_104E, encodes 16S rRNA
agagtttgatcctggctcaggataaacgctggcggcgtgcctaatacatgcaagtcgaacgaggaagacccagcttgctgggttgaccgagtggcgaacgggtgagtaatacataagcaacctgcccacggagaccgggataatctctggaaacggggactaaaaccggataggcagcaatgaggcatctcaatgctgttaaaggtgagagacactggtggatgggcttatggcgcattagttagttggtgaggtaagggcccaccaagacgatgatgcgtagccggcctgagagggtga

SEQ ID NO: 5541 - DNA, 300 bp, Unknown
  Ascusbbf_104F, encodes 16S rRNA
agagtttgatcatggctcaggataaacgctggcggcgtgcctaatacatgcaagtcgaacgaggaagacccagcttgctgggttgaccgagtggcgaacgggtgagtaatacataagcaacctgcccacggagaccgggataatctctggaaacggggactaaaaccggataggcagcaatgaggcatctcaatgctgttaaaggtgagagacactggtggatgggcttatggcgcattagttagttggtgaggtaacggcccaccaaggcgacgatcagtagccggtctgagaggatga

SEQ ID NO: 5542 - DNA, 301 bp, Unknown
  Ascusbbf_104G, encodes 16S rRNA
agagtttgatcatggctcaggataaacgctggcggcgtgcctaatacatgcaagtcgaacgagggagacccagcttgctgggttgaccgagtggcgaacgggtgagtaatacataagcaacctgcccacggagaccgggataatctctggaaacggggactaaaaccggataggcagcaatgaggcatctcaatgctgttaaaggtgagagacactggtggatgggcttatggcgcattagttagttggtgaggtaacggcccaccaagacgatgatgcgtagccggcctgagagggtgaa

SEQ ID NO: 5543 - DNA, 300 bp, Unknown
  Ascusbbf_104H, encodes 16S rRNA
agagtttgatcatggctcaggataaacgctggcggcgtgcctaatacatgcaagtcgaacgagggagacccagcttgctgggttgaccgagtggcgaacgggtgagtaatacataagcaacctgcccacagagaccgggataatctctggaaacggggactaaaaccggataggcagcaatgaggcatctcaatgctgttaaaggtgagagacactggtggatgggcttatggcgcattagttagttggtgaggtaacggcccaccaagacgatgatgcgtagccggcctgagagggtga

SEQ ID NO: 5544 - DNA, 300 bp, Unknown
  Ascusbbf_104I, encodes 16S rRNA
agagtttgatcatggctcaggataaacgctggcggcgtgcctaatacatgcaagtcgaacgaggaagacccagcttgctgggttgaccgagtggcgaacgggtgagtaatacataagcaacctgcccacggagaccgggataatctctggaaacggggactaaaaccggataggcagcaatgaggcatctcaatgctgttaaaggtgagagacactggtggatgggcttatggcgcattagctagttggtgaggtaacggcccaccaaggcgacgatcagtagccggactgagaggttga

SEQ ID NO: 5545 - DNA, 301 bp, Unknown
  Ascusbbf_148A, encodes 16S rRNA
agagtttgatcctggctcaggatgaacgctggcggcgtgcctaacacatgcaagtcgaacgagcgagagatgaaacctagtgattctcgagcgagtggcggacgggtgagtaacgcgtgggtaacctgccttacagagggggataacagtttgaaaagactgctaataccgcataagcacacagtaccgcatggtacagggtgaaaagatttatcactgtaagatggacccgcgtctgattagccagttggcagggtaacggcctaccaaagcgacgatcagtagccgacctgagagggtg

SEQ ID NO: 5546 - DNA, 301 bp, Unknown
  Ascusbbf_148B, encodes 16S rRNA
agagtttgatcctggctcaggatgaacgctggcggcgtgcctaacacatgcaagtcgaacgagcgagagatgaaacctagtgattctcaagcgagtggcggacgggtgagtaacgcgtgggtaacctgccttacagagggggataacagtctgaaaagactgctaataccgcataagcacacagtaccgcatggtacagggtgaaaagatttatcactgtaagatggacccgcgtctgattagccagttggcagggtaacggcctaccaaagcgacgatcagtagccgacctgagagggtg

SEQ ID NO: 5547 - DNA, 301 bp, Unknown
  Ascusbbf_148C, encodes 16S rRNA
agagtttgatcatggctcaggatgaacgctggcggcgtgcctaacacatgcaagtcgaacgagcgagagatgaaacctagtgattctcaagcgagtggcggacgggtgagtaacgcgtgggtaacctgccttacagagggggataacagtctgaaaagactgctaataccgcataagcacacagtaccgcatggtacagggtgaaaagatttatcactgtaagatggacccgcgtctgattagccagttggcagggtaacggcctaccaaagcgacgatcagtagccgacctgagagggtg

SEQ ID NO: 5548 - DNA, 301 bp, Unknown
  Ascusbbf_148D, encodes 16S rRNA
agagtttgatcctggctcaggatgaacgctggcggcgtgcctaacacatgcaagtcgaacgagcgagagatgaaacctagtgaatctcgagcgagtggcggacgggtgagtaacgcgtgggtaacctgccttacagagggggataacagtttgaaaagactgctaataccgcataagcacacagtaccgcatggtacagggtgaaaagatttatcactgtaagatggacccgcgtctgattagccagttggcagggtaacggcctaccaaagcgacgatcagtagccgacctgagagggtg

SEQ ID NO: 5549 - DNA, 301 bp, Unknown
  Ascusbbf_148E, encodes 16S rRNA
agagtttgatcatggctcaggatgaacgctggcggcgtgcctaacacatgcaagtcgaacgagcgaggtatgaaacctagtgattaccgagcgagtggcggacgggtgagtaacgcgtgggtaacctgccttacagagggggataacagtttgaaaagactgctaataccgcataagcacacagtaccgcatggtacagggtgaaaagatttatcactgtaagatggacccgcgtctgattagccagttggcagggtaacggcctaccaaagcgacgatcagtagccgacctgagagggtg

SEQ ID NO: 5550 - DNA, 300 bp, Unknown
  Ascusbbf_148F, encodes 16S rRNA
agagtttgatcctggctcagattgaacgctggcggcaggcttaatacatgcaagtcgaacggtaacagcaggaagcttgcttcctggctgacgagtggcggacgggtgagtaatacctggggagctgcctgaatgagggggacaacacctggaaacgggtgctaataccgcgtaagccctgagggggaaaggctgggcaaccagtcgcattcagatgcgcccaggtgggattagctagttggtggggtaacggcctaccaaggcgacgatctctagctggtctgagaggatgatcagcca

SEQ ID NO: 5551 - DNA, 301 bp, Unknown
  Ascusbbf_148G, encodes 16S rRNA
agagtttgatcatggctcaggatgaacgctggcggcgtgcctaacacatgcaagtcgaacgagcgagagatgaaacctagtgaatttcgagcgagtggcggacgggtgagtaacgcgtgggtaacctgccttacagagggggataacagtttgaaaagactgctaataccgcataagcacacagtaccgcatggtacagggtgaaaagatttatcactgtaagatggacccgcgtctgattagccagttggcagggtaacggcctaccaaagcgacgatcagtagccgacctgagagggtg

SEQ ID NO: 5552 - DNA, 301 bp, Unknown
  Ascusbbf_148H, encodes 16S rRNA
agagtttgatcatggctcaggatgaacgctggcggcgtgcctaacacatgcaagtcgaacgagcgagagatgaaacctagtgattcttgagcgagtggcggacgggtgagtaacgcgtgggtaacctgccttacagagggggataacagtttgaaaagactgctaataccgcataagcacacagtaccgcatggtacagggtgaaaagatttatcactgtaagatggacccgcgtctgattagccagttggcagggtaacggcctaccaaagcgacgatcagtagccgacctgagagggtg

SEQ ID NO: 5553 - DNA, 225 bp, Unknown
  Ascusbbf_944A, encodes 16S rRNA
agagtttgatcatggctcaggatgaacgctagctacaggcttaacacatgcaagtcgaggggtaacatgaagaaagcttgctttctttgatgacgaccggcgcacgggtgagtatcgcgtatccaacctgcccataagtagggaatagccttgcgaaagtaagattaatgccctatggtttccattaaagacatctgagatggaataaagatttatcgcttatgg

SEQ ID NO: 5554 - DNA, 300 bp, Unknown
  Ascusbbf_944B, encodes 16S rRNA
agagtttgatcctggctcaggatgaacgctagctacaggcttaacacatgcaagtcgaggggtaacatgaagaaagcttgctttctttgatgacgaccggcgcacgggtgagtatcgcgtatccaacctgcccataagtagggaatagccttgcgaaagtaagattaatgccctatggtttccgttaaagacatctgagatggaataaagatttatcgcttatggatggggatgcgtctgattaggtagtaggcggggtaacggcccacctagccgacgatcagtaggggttctgagagg

SEQ ID NO: 5555 - DNA, 300 bp, Unknown
  Ascusbbf_944C, encodes 16S rRNA
agagtttgatcctggctcaggatgaacgctagctacaggcttaacacatgcaagtcgaggggtaacatgaagaaagcttgctttctttgatgacgaccggcgcacgggtgagtatcgcgtatccaacctgcccataagtagggaatagccttgcgaaagtaagattaatgccctatggtttccattaaagacatctgagatggaataaagatttatcgcttatggatggggatgcgtctgattaggtagtaggcggggtaacggcccacctagccgacgatcagtaggggttctgagagg

SEQ ID NO: 5556 - DNA, 300 bp, Unknown
  Ascusbbf_944D, encodes 16S rRNA
agagtttgatcatggctcaggatgaacgctagctacaggcttaacacatgcaagtcgaggggtaacatgaagaaagcttgctttctttgatgacgaccggcgcacgggtgagtatcgcgtatccaacctgcccataagtagggaatagccttgcgaaagtaagattaatgccctatggtttccgttaaagacatctgagatggaataaagatttatcgcttatggatggggatgcgtctgattaggtagtaggcggggtaacggcccacctagccgacgatcagtaggggttctgagagg

SEQ ID NO: 5557 - DNA, 300 bp, Unknown
  Ascusbbf_944E, encodes 16S rRNA
agagtttgatcctggctcaggatgaacgctagctacaggcttaacacatgcaagtcgaggggtaacatgaagaaagcttgctttctttgatgacgaccggcgcacgggtgagtatcgcgtatccaacctgcccataagtagggaatagccttgcgaaagtaagattaatgccctatggtttccattgaagacatctgagatggaataaagatttatcgcttatggatggggatgcgtctgattaggtagtaggcggggtaacggcccacctagccgacgatcagtaggggttctgagagg

SEQ ID NO: 5558 - DNA, 300 bp, Unknown
  Ascusbbf_944F, encodes 16S rRNA
agagtttgatcctggctcaggatgaacgctagctacaggcttaacacatgcaagtcgaggggtaacatgaagaaagcttgctttctttgatgacgaccggcgcacgggtgagtatcgcgtatccaacctgcccataagtagggaatagccttgcgaaagtaagattaatgccctatggtttccgtcgtagacatcttagatggaataaagatttatcgcttatggatggggatgcgtctgattaggtagtaggcggggtagcggcccacctagccgacgatcagtaggggttctgagagg

SEQ ID NO: 5559 - DNA, 300 bp, Unknown
  Ascusbbf_944G, encodes 16S rRNA
agagtttgatcatggctcaggatgaacgctagctacaggcttaacacatgcaagtcgaggggtaacatgaagaaagtttgctttctttgatgacgaccggcgcacgggtgagtatcgcgtatccaacctgcccataagtagggaatagccttgcgaaagtaagattaatgccctatggcttccattgaaggcatctgagatggaataaagatttatcgcttatggatggggatgcgtctgattaggtagtaggcggggtaacggcccacctagccgacgatcagtaggggttctgagagg

SEQ ID NO: 5560 - DNA, 297 bp, Unknown
  Ascusbbf_23033A, encodes 16S rRNA
agagtttgatcctggctcaggatgaacgctggcggcgtgcttaatacatgcaagtcgaacggatgagatcaggcagcttgctgtctgattgatttagtggcgaacgggtgagtaatacgtaggcaacctgccccaaagcgggggatagcagttggaaacgactattaataccgcataggtaatcttgaggcatcttgagattattaaaggtgcgtttgcaccgctgtgggatgggcttacgctgtattagcttgttggtgaggtaacggcccaccaaggcgatgatacatagccggt

SEQ ID NO: 5561 - DNA, 297 bp, Unknown
  Ascusbbf_23033B, encodes 16S rRNA
agagtttgatcatggctcaggatgaacgctggcggcgtgcttaatacatgcaagtcgaacggatgagatcagacagcttgctgcctgattgattcagtggcgaacgggtgagtaatacgtaggcaacctgccccaaagcgggggatagcagttggaaacgactattaataccgcataggtaatcttgaggcatcttgagattattaaaggtgcgtttgcaccgctgtgggatgggcttacgctgtattagcttgttggtgaggtaacggcccaccaaggcgatgatacatagccggt

SEQ ID NO: 5562 - DNA, 297 bp, Unknown
  Ascusbbf_23033C, encodes 16S rRNA
agagtttgatcctggctcaggatgaacgctggcggcgtgcttaatacatgcaagtcgaacggatgagatcagacagcttgctgcctgattgattcagtggcgaacgggtgagtaatacgtaggcaacctgccccaaagcgggggatagcagttggaaacgactattaataccgcataggtaatcttgaggcatcttgagattattaaaggtgcgtttgcaccgctgtgggatgggcttacgctgtattagcttgttggtgaggtaacggcccaccaaggcgatgatacatagccggt

SEQ ID NO: 5563 - DNA, 297 bp, Unknown
  Ascusbbf_23033D, encodes 16S rRNA
agagtttgatcatggctcaggatgaacgctggcggcgtgcttaatacatgcaagtcgaacggatgagatcaggcagcttgctgtctgattgatttagtggcgaacgggtgagtaatacgtaggcaacctgccccaaagcgggggatagcagttggaaacgactattaataccgcataggtaatcttgaggcatcttgagattattaaaggtgcgtttgcaccgctgtgggatgggcttacgctgtattagcttgttggtgaggtaacggcccaccaaggcgatgatacatagccggt

SEQ ID NO: 5564 - DNA, 225 bp, Unknown
  Ascusbbf_2600A, encodes 16S rRNA
agagtttgatcatggctcagattgaacgctggcggcatgccttacacatgcaagtcgaacggcagcgggggagcttgctcctgccggcgagtggcgaacgggtgagtaatgcatcggaacgtgtcctgtcgtgggggataactggccgaaaggtcagctaataccgcatgagacccgagggtgaaagcgggggatcgcaagacctcgcgcgactggagcggccga

SEQ ID NO: 5565 - DNA, 299 bp, Unknown
  Ascusbbf_2600B, encodes 16S rRNA
agagtttgatcctggctcagattgaacgctggcggcatgccttacacatgcaagtcgaacggcagcgggggagcttgctcctgccggcgagtggcgaacgggtgagtaatgcatcggaacgtgtcctgtcgtgggggataactggccgaaaggtcagctaataccgcatgagacccgagggtgaaagcgggggatcgcaagacctcgcgcgactggagcggccgatgtctgattagctggttggtggggtaaaagcttaccaaggcgacgatcagtagctggtctgagaggatgatcag

SEQ ID NO: 5566 - DNA, 299 bp, Unknown
  Ascusbbf_2600C, encodes 16S rRNA
agagtttgatcatggctcagattgaacgctggcggcatgccttacacatgcaagtcgaacggcagcgggggagcttgctcctgccggcgagtggcgaacgggtgagtaatgcatcggaacgtgtcctgtcgtgggggataactggccgaaaggtcagctaataccgcatgagacccgagggtgaaagcgggggatcgcaagacctcgcgcgactggagcggccgatgtctgattagctggttggtggggtaaaagcttaccaaggcgacgatcagtagctggtctgagaggatgatcag

SEQ ID NO: 5567 - DNA, 299 bp, Unknown
  Ascusbbf_2600D, encodes 16S rRNA
agagtttgatcatggctcagattgaacgctggcggcatgccttacacatgcaagtcgaacggcagcgggggagcttgctcctgccggcgagtggcgaacgggtgagtaatgcatcggaacgtgtcctgtcgtgggggataactgaccgaaaggtcagctaataccgcatgagacccgagggtgaaagcgggggatcgcaagacctcgcgcgactggagcggccgatgtctgattagctggttggtggggtaaaagcttaccaaagcgacgatcagtagctggtctgagaggatgatcag

SEQ ID NO: 5568 - DNA, 299 bp, Unknown
  Ascusbbf_2600E, encodes 16S rRNA
agagtttgatcctggctcagattgaacgctggcggcatgccttacacatgcaagtcgaacggcagcgggggagcttgctcctgccggcgagtggcgaacgggtgagtaatgcatcggaacgtgtcctgtcgtgggggataactgaccgaaaggtcagctaataccgcatgagacccgagggtgaaagcgggggatcgcaagacctcgcgcgactggagcggccgatgtctgattagctggttggtggggtaaaagcttaccaaagcgacgatcagtagctggtctgagaggatgatcag

SEQ ID NO: 5569 - DNA, 299 bp, Unknown
  Ascusbbf_2600F, encodes 16S rRNA
agagtttgatcatggctcaggacgaacgctggcggcatgccttacacatgtaagtcgaacggcagcgggggagcttgctcctgccggcgagtggcgaacgggtgagtaatgcatcggaacgtgtcctgtcgtgggggataactggccgaaaggtcagctaataccgcatgagacccgagggtgaaagcgggggatcgcaagacctcgcgcgactggagcggccgatgtctgattagctggttggtggggtaaaagcttaccaaggcgacgatcagtagctggtctgagaggatgatcag

SEQ ID NO: 5570 - DNA, 300 bp, Unknown
  Ascusbbf_2600G, encodes 16S rRNA
agatttgattatggctcagattgaacgctggcggcatgccttacacatgcaagtcgaacggcagcgggggagttgctcctgccggcgagtggcgaacgggtgagtaatgcatcggaacgtgtcctgtcgtgggggataactggccgaaaggtcagctaataccgcatgagacccgagggtgaaagcgggggatcgcaagacctcgcgcgactggagcggccgatgtctgattagctggttggtggggtaaaagcttaccaaggcgacgatcagtagctggtctgagaggatgatcagcca

SEQ ID NO: 5571 - DNA, 301 bp, Unknown
  Ascusbbf_2600H, encodes 16S rRNA
agagtttgatcctggctcagattgaacgctggcggcaggcctaatacatgcaagtcgaacggtaacataaaagaagcttgcttcttttgatgacgagtggcggacgggtgagtaatatttgggaaactacctgatagagggggacaacagttggaaacgactgctaataccgcataaagcctaagggtgaaagcagcaatgcgctatcagatgtgcccaaacgggattagctagtaggtgaggtaaaggctcacctaggcgacgatctctagctggtctgagaggatgatcagccacattg

SEQ ID NO: 5572 - DNA, 300 bp, Unknown
  Ascusbbf_8118A, encodes 16S rRNA
agagtttgatcctggctcaggatgaacgctagctacaggcttaacacatgcaagtcgaggggcatcatgtgaggacttcggtcctttcgatggcgaccggcgaatgggtgagtaacacgtatccgacctgccctgtactggaggatagcctcccgaaagggaaattaatactccatgtgtcatgttgcttcatggtggcatgatgaaagatttatcggtacaggatggggatgcgttccattagccagccggcggggtaacggcccaccggggcgacgatggataggggttctgagagga

SEQ ID NO: 5573 - DNA, 300 bp, Unknown
  Ascusbbf_8118B, encodes 16S rRNA
agagtttgatcatggctcaggatgaacgctagctacaggcttaacacatgcaagtcgaggggcatcatgtgaggacttcggtcctttcgatggcgaccggcgaatgggtgagtaacacgtatccgacctgccctgtactggaggatagcctcccgaaagggaaattaatactccatgtgtcatgttgcttcatggtggcatgatgaaagatttatcggtacaggatggggatgcgttccattagccagccggcggggtaacggcccaccggggcgacgatggataggggttctgagagga

SEQ ID NO: 5574 - DNA, 300 bp, Unknown
  Ascusbbf_201A, encodes 16S rRNA
agagtttgatcctggctcaggatgaacgctagctacaggcttaacacatgcaagtcgaggggcagcatatagatagcttgctatttatgatggcgaccggcgcacgggtgagtaacgcgtatccaaccttccctatactagagaatagcccggcgaaagtcggattaatgctctatgttcttctttgatggcatctgacgagaagcaaaggtttaccggtataggatggggatgcgtctgattaggttgttggcggggtaacggcccaccaagcctacgatcagtaggggttctgagagg

SEQ ID NO: 5575 - DNA, 301 bp, Unknown
  Ascusbbf_201J, encodes 16S rRNA
agagtttgatcatggctcaggatgaacgctagctacaggcttaacacatgcaagtcgaggggcagcatatagatagcttgctatttatgatggcgaccggcgcacgggtgagtaacgcgtatccaaccttccctatactagagaatagcccggcgaaagtcggattaatgctctatgttcttctttgatggcgtctgacgagaagcaaaggtttaccggtataggatggggatgcgtctgattaggttgttggcggggtaacggcccaccaagcctacgatcagtaggggttctgagagga

SEQ ID NO: 5576 - DNA, 301 bp, Unknown
  Ascusbbf_201K, encodes 16S rRNA
agagtttgatcatggctcaggatgaacgctagctacaggcttaacacatgcaagtcgaggggcagcatatagatagcttgctatttatgatggcgaccggcgcacgggtgagtaacgcgtatccaaccttccctatactagagaatagcccggcgaaagtcggattaatgctctatgttcttctttgatggcatctgacgagaagcaaaggtttaccggtataggatggggatgcgtctgattaggttgttggcggggtaacggcccaccaagcctacgatcagtaggggttctgagagga

SEQ ID NO: 5577 - DNA, 301 bp, Unknown
  Ascusbbf_201L, encodes 16S rRNA
agagtttgatcctggctcaggacgaacgctggcggcgtgcttaacacatgcaagtcgaacgagacgatttagaagcttgcttttattgagtcgagtggcaaacgggtgagtaacgcgtagacaacctgccgcaaagatggggacaacagtccgaaaggactgctaataccgaatgttgtatctcctccgcatgaaagagatattaaagatggcctctacttgtaagctatcgctttgcgatgggtctgcgtctgattagctagttggtggggcaacggcctaccaaggcaacgatcagtag

SEQ ID NO: 5578 - DNA, 300 bp, Unknown
  Ascusbbf_10712A, encodes 16S rRNA
agagtttgatcctggctcaggacgaacgctggcggcgtgcttaacacatgcaagtcgaacgagaagagatgagaagcttgcttcttattgattcgagtggcaaacgggtgagtaacgcgtaagcaacctgcccttcagatggggacaacagctggaaacggctgctaataccgaatacgttctttctgccgcatgacagagggaagaaagggaggctcttcggagctttcgctggaggagggacttgcgtctgattagctagttggaggggtaacggcccaccaaggcgacgatcagtag

SEQ ID NO: 5579 - DNA, 225 bp, Unknown
  Ascusbbf_10712B, encodes 16S rRNA
agagtttgatcatggctcaggacgaacgctggcggcgtgcttaacacatgcaagtcgaacgagaagagatgagaagcttgcttcttattgattcgagtggcaaacgggtgagtaacgcgtaagcaacctgcccttcagatggggacaacagctggaaacggctgctaataccgaatacgttctttttgtcgcatggcagagggaagaaagggaggctcttcggag

SEQ ID NO: 5580 - DNA, 300 bp, Unknown
  Ascusbbf_10712C, encodes 16S rRNA
agagtttgatcctggctcaggacgaacgctggcggcgtgcttaacacatgcaagtcgaacgagaagagatgagaagcttgcttcttattgattcgagtgacaaacgggtgagtaacgcgtaagcaacctgcccttcagatggggacaacagctggaaacggctgctaataccgaatacgttctttttgtcacatggcagagagaagaaagggaggctcttcggagctttcgctgaaggaggggcttgcgtctgattagctagttggaggggtaacggcccaccaaggcgacgatcagtag

SEQ ID NO: 5581 - DNA, 300 bp, Unknown
  Ascusbbf_10712D, encodes 16S rRNA
agagtttgatcctggctcaggatgaacgccggcggtgtgcctaatacatgcaagtcgaacgagaagagatgagaagcttgcttcttatcgattcgagtggcaaacgggtgagtaacgcgtaagcaacctgcccttcagatggggacaacagctggaaacggctgctaataccgaatacgttctttttgtcgcatggcagagggaagaaagggaggctcttcggagctttcgctgaaggaggggcttgcgtctgattagctagttggaggggtaacggcccaccaaggcgacgatcagtag

SEQ ID NO: 5582 - DNA, 300 bp, Unknown
  Ascusbbf_10712E, encodes 16S rRNA
agagtttgatcatggctcaggacgaacgctggcggcgtgcttaacacatgcaagtcgaacgagaagagatgagaagcttgcttcttattgattcgagtggcaaacgggtgagtaacgcgtaagcaacctgcccttcagatggggacaacagctggaaacggctgctaataccgaatacgttctttttgtcgcatggcagagggaagaaagggaggctcttcggagctttcgctgaaggaggggcttgcgtctgattagctagttggaggggtaacggcccaccaaggcgacgatcagtag

SEQ ID NO: 5583 - DNA, 300 bp, Unknown
  Ascusbbf_10712F, encodes 16S rRNA
agagtttgatcatggctcaggacgaacgctggcggcgtgcttaacacatgcaagtcgaacgagaagagatgagaagcttgcttcttattgattcgagtggcaaacgggtgagtaacgcgtaagcaacctgcccttcagatggggacaacagctggaaacggctgctaataccgaatatgttctttttgtcgcatggcagagggaagaaagggaggctcttcggagctttcgctgaaggaggggcttgcgtctgattagctagttggaggggtaacggcccaccaaggcgacgatcagtag

SEQ ID NO: 5584 - DNA, 298 bp, Unknown
  Ascusbbf_10712G, encodes 16S rRNA
agagtttgatcctggctcaggacgaacgctggcggcgtgcttaacacatgcaagtcgaacgagaagagatgagaagcttgcttcttattgattcgagtggcaaacgggtgagtaacgcgtaagcaacctgcccttcagatggggacaacagctggaaacggctgctaataccgaatacgttctttttgtcgcatggcagagagaagaaagggaggctcttcggagctttcgctgaaggaggggcttgcgtctgattagctagttggaggggtaacggcccaccaaggcgacgatcagt

SEQ ID NO: 5585 - DNA, 300 bp, Unknown
  Ascusbbf_10712H, encodes 16S rRNA
agagtttgatcctggctcaggacgaacgctggcggcgtgcttaacacatgcaagtcgaacgagaagagatgagaagcttgcttcttatcaattcgagtggcaaacgggtgagtaacgcgtaagcaacctgcccttcagatggggacaacagctggaaacggctgctaataccgaatacgttctttttgtcgcatggcagagggaagaaagggaggctcttcggagctttcgctgaaggaggggcttgcgtctgattagctagttggaggggtaacggcccaccaaggcgacgatcagtag

SEQ ID NO: 5586 - DNA, 300 bp, Unknown
  Ascusbbf_10712I, encodes 16S rRNA
agagtttgatcatggctcaggacgaacgctggcggcgtgcttaacacatgcaagtcgaacgagaagagatgagaagcttgcttcttattgattcgagtggcaaacgggtgagtaacgcgtaagcaacctgcccttcagatggggacaacagctggaaacggctgctaataccgaatacgttctttctgccgcatgacagagggaagaaagggaggctcttcggagctttcgctggaggagggacttgcgtctgattagctagttggaggggtaacggcccaccaaggcgacgatcagtag

SEQ ID NO: 5587 - DNA, 225 bp, Unknown
  Ascusbbf_6012A, encodes 16S rRNA
agagtttgatcatggctcagattgaacgctggcggcaggcctaatacatgcaagtcgaacggcagcagggggagtgcttgcactccccgctggcgagtggcggacgggtgagtagtgcctgggaagctgcctggcagagggggacaacagctggaaacggctgctgataccgcatattaccccgagggggaaaggagagatccgctgccggatgcgcccaggcgg

SEQ ID NO: 5588 - DNA, 301 bp, Unknown
  Ascusbbf_6012B, encodes 16S rRNA
agagtttgatcatggctcagattgaacgctggcggcaggcctaatacatgcaagtcgaacggcagcagggggagtgcttgcactccccgctggcgagtggcggacgggtgagtagtgcctgggaagctgcctggcagagggggacaacagctggaaacggctgctgataccgcatattaccccgagggggaaaggagagatccgctgccggatgcgcccaggcgggattagctggttggcggggcaaaggcccaccaaggcgacgatccctagctggtctgagaggatgatcagccacatt

SEQ ID NO: 5589 - DNA, 301 bp, Unknown
  Ascusbbf_6012C, encodes 16S rRNA
agagtttgatcatggctcagattgaacgctggcggcaggcctaatacatgcaagtcgaacggcagcagggggagtgcttgcacttcccgctggcgagtggcggacgggtgagtagtgcctgggaagctgcctggcagagggggacaacagctggaaacggctgctgataccgcatattaccccgagggggaaaggagagatccgctgccggatgcgcccaggcgggattagctagttggcggggcaaaggcccaccaaggcgacgatccctagctggtctgagaggatgatcagccacatt

SEQ ID NO: 5590 - DNA, 301 bp, Unknown
  Ascusbbf_6012D, encodes 16S rRNA
agagtttgatcctggctcagattgaacgctggcggcaggcctaatacatgcaagtcgaacggcagcagggggagtgcttgcacttcccgctggcgagtggcggacgggtgagtagtgcctgggaagctgcctggcagagggggacaacagctggaaacggctgctgataccgcatattaccccgagggggaaaggagagatccgctgccggatgcgcccaggcgggattagctagttggcggggcaaaggcccaccaaggcgacgatccctagctggtctgagaggatgatcagccacatt

SEQ ID NO: 5591 - DNA, 301 bp, Unknown
  Ascusbbf_6012E, encodes 16S rRNA
agagtttgatcctggctcagattgaacgctggcggcaggcctaatacatgcaagtcgaacggcagcagggggagtgcttgcactccccgctggcgagtggcggacgggtgagtagtgcctgggaagctgcctggcagagggggacaacagctggaaacggctgctgataccgcatattaccccgagggggaaaggagagatccgctgccggatgcgcccaggcggggttagctggttggcggggcaaaggcccaccaaggcgacggtccctagctggtctgagaggatgatcagccacatt

SEQ ID NO: 5592 - DNA, 300 bp, Unknown
  Ascusbbf_2297A, encodes 16S rRNA
agagtttgatcctggctcagaacgaacgctggcggcgcatcttaagcatgcaagtcgagcggtaagttggaagcttgcttctaacctagagcggcggactggtgagtaacgcgtgggtgacgtacctctgtgacggggacagctcctagaaataggagataataccggatacgctgtgtgctgtcagagggcacacaggaaaggatcttttgattcgcacagagagcggcccgcgtactattagctggttggtgaggtaacggcccaccaaggcgacgatagttacccggcctaagaggg

SEQ ID NO: 5593 - DNA, 300 bp, Unknown
  Ascusbbf_2297B, encodes 16S rRNA
agagtttgatcctggctcaggatgaacgctagctacaggcttaacacatgcaagtcgaggggcagcaggattctagcttgctagaattgctggcgaccggcgcacgggtgagtaacgcgtatccaacctggcccttagtagaggatagcccggcgaaagtcggattaatactctatgttctccaatgcgggcatctaatttggagcaaagatttatcgctatgggatggggatgcgtctgattagcttgtcggcggggtaacggcccaccgaggcaacgatcagtaggggttctgagagg

SEQ ID NO: 5594 - DNA, 301 bp, Unknown
  Ascusbbf_2297C, encodes 16S rRNA
agagtttgatcctggctcagaacgaacgctggcggcgcgtcttaagcatgcaagtcgagcggtaagttggaagcttgcttctaacctagagcggcggactggtgagtaacgcgtgggtgacgtacctctgtgacggggacagctcctagaaataggagataataccggatacgctgcatgttgtcagaggacatgcaggaaaggatcttttgattcgcacagagagcggcccgcgtactattagctagttggtgaggtaacggcccaccaaggcgacgatagttacccggcctaagagggg

SEQ ID NO: 5595 - DNA, 301 bp, Unknown
  Ascusbbf_2297D, encodes 16S rRNA
agagtttgatcctggctcagaacgaacgctggcggcgcgtcttaagcatgcaagtcgagcggtaagtcgggagcttgctcctgacctagagcggcggactggtgagtaacgcgtgggtgacgtacctctgtgacggggacagctcctagaaataggagataataccggatacgctgcatgttgtcagaggacatgcaggaaaggatcttttgattcgcacagagagcggcccgcgtactattagctggttggtgaggtaacggcccaccaaggcgacgatagttacccggcctaagagggg

SEQ ID NO: 5596 - DNA, 301 bp, Unknown
  Ascusbbf_2297E, encodes 16S rRNA
agagtttgatcctggctcagaacgaacgctggcggcgcgtcttaagcatgcaagtcgagcggtaagtcgggagcttgctcctgacctagagcggcggactggtgagtaacgcgtgggtgacgtacctctgtgacggggacagctcctagaaataggagataataccggatacgctgcatgttgtcagaggacatgcaggaaaggatcttttgattcgcacagagagcggcccgcgtactattagctagttggtgaggtaacggcccaccaaggcgacgatagttacccggcctaagagggg

SEQ ID NO: 5597 - DNA, 301 bp, Unknown
  Ascusbbf_2297F, encodes 16S rRNA
agagtttgatcatggctcagaacgaacgctggcggcgcgtcttaagcatgcaagtcgagcggtaagatggaagcttgcttctatcctagagcggcggactggtgagtaacgcgtgggtgacgtacctttgtgacggggacagctcctagaaataggagataataccggatacgctgcatgttgtcagaggacatgcaggaaaggatcttttgattcgcacagagagcggcccgcgtactattagctagttggtggggtaacggcccaccaaggcgacgatagttacccggcctaagagggg

SEQ ID NO: 5598 - DNA, 301 bp, Unknown
  Ascusbbf_2297G, encodes 16S rRNA
agagtttgatcatggctcagaacgaacgctggcggcgcgtcttaagcatgcaagtcgagcggtaagttggaagcttgcttctaacctagagcggcggactggtgagtaacgcgtgggtgacgtacctctgtgacggggacagctcctagaaataggagataataccggatacgctgcatgttgtcagaggacatgcaggaaaggatcttttgattcgcacagagagcggcccgcgtactattagctagttggtgaggtaacggcccaccaaggcgacgatagttacccggcctaagagggg

SEQ ID NO: 5599 - DNA, 301 bp, Unknown
  Ascusbbf_2297H, encodes 16S rRNA
agagtttgatcctggctcagaacgaacgctggcggcgcgtcttaagcatgcaagtcgagcggtaagtcgggagcttgctcctgacctagagcggcggactggtgagtaacgcgtgggtgacgtacctctgtgacggggacagctcctagaaataggagataataccggatacgctgcatgttgtcagaggacatgcaggaaaggatcttttgattcgcacagagagcggcccgcgtactattagctggttggtgaggtaacggcccaccaaggcgacgataggtacccggcctaagagggg

SEQ ID NO: 5600 - DNA, 298 bp, Unknown; identical to SEQ ID NO: 5480
  Ascusbbf_873A, encodes 16S rRNA

SEQ ID NO: 5601 - DNA, 299 bp, Unknown
  Ascusbbf_873B, encodes 16S rRNA
agagtttgatcctggctcaggacgaacgctggcggcgtgcttaacacatgcaagtcgaacgagaatctgtggatcgaggattcgtccaagtgaagcagaggacagtggcggacgggtgagtaacgcgtgaggaacctgcctttcagagggggacaacagttggaaacgactgctaataccgcatgatacatttgggtggcatcatctgaatgtcaaagatttatcgctgaaagatggcctcgcgtctgattagctagttggtgaggtaacggcccaccaaggcgacgatcagtagccgg

SEQ ID NO: 5602 - DNA, 300 bp, Unknown
  Ascusbbf_873C, encodes 16S rRNA
agagtttgatcatggctcaggacgaacgctggcggcgtgcttaacacatgcaagtcgaacgagaatctgtggatcgaggattcgtccaagtgaagcagaggacagtggcggacgggtgagtaacgcgtgaggaacctgcctttcagagggggacaacagttggaaacgactgctaataccgcatgacacattcgagcggcatcgcttgaatgtcaaagatttatcgctgaaagatggcctcgcgtctgattagctagttggtgaggtaacggcccaccaaggcgacgatcagtagccgga

SEQ ID NO: 5603 - DNA, 300 bp, Unknown
  Ascusbbf_873D, encodes 16S rRNA
agagtttgatcctggctcaggacgaacgctggcggcgtgcttaacacatgcaagtcgaacgagaatctgtggatcgaggattcgtccaagtgaagcagaggacagtggcggacgggtgagtaacgcgtgaggaacctgcctttcagagggggacaacagttgggaacgactgctaataccgcatgatacatttgggtggcatcatctgaatgtcaaagatttatcgctgaaagatggcctcgcgtctgattagctagttggtgaggtaacggcccaccaaggcgacgatcagtagccggg

SEQ ID NO: 5604 - DNA, 300 bp, Unknown
  Ascusbbf_873E, encodes 16S rRNA
agagtttgatcctggctcaggacgaacgctggcggcgtgcttaacacatgcaagtcgaacgagaatctgtggatcgaggattcgtccaagtgaagcagaggacagtggcggacgggtgagtaacgcgtgaggaacctgcctttcagagggggacaacagttggaaacgactgctaataccgcatgacacattcgagcggcatcgcttgaatgtcaaagatttatcgctgaaagatggcctcgcgtctgattagctagttggtgaggtaacggcccaccaaggcgacgatcagtagccgga

SEQ ID NO: 5605 - DNA, 300 bp, Unknown
  Ascusbbf_873F, encodes 16S rRNA
agagtttgatcatggctcaggacgaacgctggcggcgtgcttaacacatgcaagtcgaacgagaatctgtggatcgaggattcgtccaagtgaagcagaggacagtggcggacgggtgagtaacgcgtgaggaacctgcctttcagagggggacaacagttggaaacgactgctaataccgcatgatacatttgggtggcatcatctgaatgtcaaagatttatcgctgaaagatggcctcgcgtctgattagctagttggtgaggtaacggcccaccaaggcgacgatcagtagccgga

SEQ ID NO: 5606 - DNA, 300 bp, Unknown
  Ascusbbf_873G, encodes 16S rRNA
agagtttgatcatggctcagagcgaacgctggcggcgtgcttaacacatgcaagtcgaacgagaatctgtggatcgaggattcgtccaagtgaagcagaggacagtggcggacgggtgagtaacgcgtgaggaacctgcctttcagagggggacaacagttggaaacgactgctaataccgcatgacacattcgagcggcatcgcttgaatgtcaaagatttatcgctgaaagatggcctcgcgtctgattagctagttggtgaggtaacggcccaccaaggcgacgatcagtagccgga

SEQ ID NO: 5607 - DNA, 300 bp, Unknown
  Ascusbbf_269A, encodes 16S rRNA
agagtttgatcctggctcaggacgaacgctggcggcgtgcttaacacatgcaagtcgaacggaaaggccccgctcgcggggtactcgagtggcgaacgggtgagtaacacgtgggtgatctgccctgcacttcgggataagcctgggaaactgggtctaataccggatatgacctccctttagtgtggggggtggaaagatttatcggtgcaggatgagcccgcggcctatcagcttgttggtggggtaatggcctaccaaggcgtcgacgggtagccggcctgagagggtggacggcca

SEQ ID NO: 5608 - DNA, 300 bp, Unknown
  Ascusbbf_269B, encodes 16S rRNA
agagtttgatcatggctcaggacgaacgctggcggcgtgcttaacacatgcaagtcgaacggaaaggccccgctcgcggggtactcgagtggcgaacgggtgagtaacacgtgggtgatctgccctgcacttcgggataagcctgggaaactgggtctaataccggataggaccctcctttagtgtggggggtggaaagtttttcggtgcaggatgagcccgcggcctatcagcttgttggtggggtaatggcctaccaaggcgtcgacgggtagccggcctgagagggtggacggccac

SEQ ID NO: 5609 - DNA, 300 bp, Unknown
  Ascusbbf_269C, encodes 16S rRNA
agagtttgatcatggctcaggacgaacgctggcggcgtgcttaacacatgcaagtcgaacggaaaggccccgctcgcggggtactcgagtggcgaacgggtgagtaacacgtgggtgatctgccctgcacttcgggataagcctgggaaactgggtctaataccggatatgacctccctttagtgtggggggtggaaagatttatcggtgcaggatgagcccgcggcctatcagcttgttggtggggtaatggcctaccaaggcgtcgacgggtagccggcctgagagggtggacggcca

SEQ ID NO: 5610 - DNA, 300 bp, Unknown
  Ascusbbf_269D, encodes 16S rRNA
agagtttgatcctggctcaggacgaacgctggcggcgtgcttaacacatgcaagtcgaacggaaaggccccgcttgcggggtactcgagtggcgaacgggtgagtaacacgtgggtgatctgccctgcacttcgggataagcctgggaaactgggtctaataccggatatgacctccctttagtgtggggggtggaaagatttatcggtgcaggatgagcccgcggcctatcagcttgttggtggggtaatggcctaccaaggcgtcgacgggtagccggcctgagagggtggacggcca

SEQ ID NO: 5611 - DNA, 300 bp, Unknown
  Ascusbbf_269E, encodes 16S rRNA
agagtttgatcatggctcaggacgaacgctggcggcgtgcttaacacatgcaagtcgaacggaaaggccccgcttgcggggtactcgagtggcgaacgggtgagtaacacgtgggtgatctgccctgcacttcgggataagcctgggaaactgggtctaataccggataggacccctctttagtgtggggggtggaaagttttttcggtgtgggatgagcccgcggcctatcagcttgttggtggggtaatggcctaccaaggcgtcgacgggtagccggcctgagagggtggacggcca

SEQ ID NO: 5612 - DNA, 298 bp, Unknown; identical to SEQ ID NO: 5480
  Ascusbbf_269F, encodes 16S rRNA

SEQ ID NO: 5613 - DNA, 298 bp, Unknown; identical to SEQ ID NO: 5480
  Ascusbbf_269G, encodes 16S rRNA

SEQ ID NO: 5614 - DNA, 300 bp, Unknown
  Ascusbbf_41015A, encodes 16S rRNA
agagtttgatcatggctcaggatgaacgctggcggcgtgcttaacacatgcaagtcgaacgattaacccatcttcggatggttataaagtggcgaacgggtgagtaacacgtgaccaacctgcctttcacattgggataactaagggaaactgtagctaataccaaatactccggcacctccgcatggtagtgccgggaaagctccggcggtgaaagatggggtcgcggcccattaggtagttggtggggtaacggcctaccaagcccgcgatgggtagccgggttgagagactgatcgg

SEQ ID NO: 5615 - DNA, 300 bp, Unknown
  Ascusbbf_41015B, encodes 16S rRNA
agagtttgatcctggctcaggatgaacgctggcggcgtgcttaacacatgcaagtcgaacgattaacccatcttcggatggttataaagtggcgaacgggtgagtaacacgtgaccaacctgcctttcacattgggataactaagggaaactgtagctaataccaaatactccggcacctccgcatggtagtgccgggaaagctccggcggtgaaagatggggtcgcggcccattaggtagttggtggggtaacggcctaccaagcccatgatgggtagccgggttgagagactgatcgg

SEQ ID NO: 5616 - DNA, 300 bp, Unknown
  Ascusbbf_41015C, encodes 16S rRNA
agagtttgatcctggctcaggatgaacgctggcggcgtgcttaacacatgcaagtcgaacgattaacccatcttcggatggttataaagtggcgaacgggtgagtaacacgtgactaacctgcctttcacattgggataactaccggaaacgatagctaataccaaatactccggcacttccgcatggtcgtgccgggaaagctccggcggtgaaagatggggtcgcggcccattaggtagttggtggggtaacggcctaccaagcccgcgatgggtagccgggttgagagactgatcgg

SEQ ID NO: 5617 - DNA, 300 bp, Unknown
  Ascusbbf_41015D, encodes 16S rRNA
agagtttgatcctggctcaggatgaacgctggcggcgtgcttaacacatgcaagtcgaacgattaacccatcttcggatggttataaagtggcgaacgggtgagtaacacgtgaccaacctgcctttcacattgggataactattggaaacgatagctaataccaaatactccggtacctccgcatggcggttccgggaaagctccggcggtgaaagatggggtcgcggcccattaggtagttggtggggtaacggcctaccaagcccgcgatgggtagccgggttgagagactgatcgg

SEQ ID NO: 5618 - DNA, 300 bp, Unknown
  Ascusbbf_41015E, encodes 16S rRNA
agagtttgatcatggctcaggatgaacgctggcggcgtgcttaacacatgcaagtcgaacgattaacccatcttcggatggttataaagtggcgaacgggtgagtaacacgtgaccaacctgcctttcacattgggataactattggaaacgatagctaataccaaatactccggtacctccgcatggcggttccgggaaagctccggcggtgaaagatggggtcgcggcccattaggtagttggtggggtaacggcctaccaagcccgcgatgggtagccgggttgagagactgatcgg

SEQ ID NO: 5619 - DNA, 300 bp, Unknown; identical to SEQ ID NO: 5618
  Ascusbbf_32877A, encodes 16S rRNA

SEQ ID NO: 5620 - DNA, 300 bp, Unknown
  Ascusbbf_57294A, encodes 16S rRNA
agagtttgatcatggctcaggatgaacgctggcggcgtgcttaacacatgcaagtcgagcgaagcacttaagtttgattcttcggatgaagacttttgtgactgagcggcggacgggtgagtaacgcgtgggtaacctgcctcatacagggggataacagctagaaatgactgctaataccgcataagaccacggtaccgcatggtacagtggtaaaaactccggtggtatgagatggacccgcgtctgattaggtagttggtggggtaacggcctaccaagccgacgatcagtagccga

SEQ ID NO: 5621 - DNA, 300 bp, Unknown
  Ascusbbf_57294B, encodes 16S rRNA
agagtttgatcctggctcaggatgaacgctggcggcgtgcttaacacatgcaagtcgagcgaagcacttaagtttgattcttcggatgaagacttttgtgactgagcggcggacgggtgagtaacgcgtgggtaacctgcctcatacagggggataacagttagaaatgactgctaataccgcataagaccacggtaccgcatggtacagtggtaaaaactccggtggtatgagatggacccgcgtctgattaggtagttggtggggtaacggcctaccaagccgacgatcagtagccga

SEQ ID NO: 5622 - DNA, 299 bp, Unknown
  Ascusbbf_57294C, encodes 16S rRNA
agagtttgatcatggctcaggatgaacgctggcggcgtgcttaacacatgcaagtcgagcgaagcacttaggtttgattcttcggatgaagacctttgtgactgagcagcggacgggtgagtaacgcgtgggtaacctgcctcatacagggggataacagttagaaatgactgctaataccgcataagaccacggtaccgcatggtacagtggtaaaaactccggtggtatgagatggacccgcgtctgattaggtagttggtggggtaacggcctaccaagccgacgatcagtagccg

SEQ ID NO: 5623 - DNA, 299 bp, Unknown
  Ascusbbf_27932A, encodes 16S rRNA
agagtttgatcctggctcaggatgaacgctggcggcgtgcctaacacatgcaagtcgaacgaagtttgtttctacccgacggattatcttcggataagaagtcatttgaaacgcttagtggcggacgggtgagtaacgcgtgggcaacctgccctgcacagggggatagcagttggaaacgactggtaataccgcatatattgcatttgccgcatgacagatgcaagaaaacgtttagtggtgcaggatgggcccgcgtccgattagttagttggtggggtaacggcctaccaagacga

SEQ ID NO: 5624 - DNA, 301 bp, Unknown
  Ascusbbf_27932B, encodes 16S rRNA
agagtttgatcatggctcaggatgaacgctggcggcgtgcctaacacatgcaagtcgaacgaagtttgtttctacccgacggattatcttcggataagaagtcatttgaaacgcttagtggcggacgggtgagtaacgcgtgggcaacctgccctgcacagggggatagcagttggaaacgactggtaataccgcatatattgcatttgccgcatgacagatgcaagaaaacgtttagtggtgcaggatgggcccgcgtccgattagttagttggtggggtaacggcctaccaagacgacg

SEQ ID NO: 5625 - DNA, 299 bp, Unknown
  Ascusbbf_27932C, encodes 16S rRNA
agagtttgatcctggctcaggatgaacgctggcggcgtgcctaacacatgcaagtcgaacgaagtttgtttctacccgacggattatcttcggataagaagtcatttgaaacgcttagtggcggacgggtgagtaacgcgtgggcaacctgccctgcacagggggatagcagttggaaacgactggtaataccgcatatattgcatatgccgcatgacagatgcaagaaaacgtttagtggtgcaggatgggcccgcgtccgattagttagttggtggggtaacggcctaccaagacga

SEQ ID NO: 5626 - DNA, 301 bp, Unknown
  Ascusbbf_22558A, encodes 16S rRNA
agagtttgatcctggctcaggacgaacgctggcggcgtgcttaacacatgcaagtcgaacggggcgaagaagagcttgctctttggagcctagtggcaaacgggtgagtaacgcgtaggcaacctgcccttcagatggggacaacacctcgaaaggggtgctaataccgaatgacgtatgctggtcgcatgaccggcataccaaaggccgggcaaccggtcactgaaggatgggcctgcgtctgattagctagttggtggggtaacggcccaccaaggcgacgatcagtagccggtctgag

SEQ ID NO: 5627 - DNA, 301 bp, Unknown
  Ascusbbf_22558B, encodes 16S rRNA
agagtttgatcatggctcaggatgaacgctggcggcgtgcttaacacatgcaagtcgaacggggcgaagaagagcttgctctttggagcctagtggcaaacgggtgagtaacgcgtaggcaacctgcccttcagatggggacaacacctcgaaaggggtgctaataccgaatgacgtatgctggtcgcatgactgacataccaaaggccgggcaaccggtcactgaaggatgggcctgcgtctgattagctagttggtggggtaacggcccaccaaggcgacgatcagtagccggtctgag

SEQ ID NO: 5628 - DNA, 301 bp, Unknown
  Ascusbbf_983757A, encodes 16S rRNA
agagtttgatcatggctcaggatgaacgctagctacaggcttaacacatgcaagtcgaggggcagcatgagggtagcaatacctttgatggcgaccggcgcacgggtgcgtaacacgtatccaatctacccatggctcgggaatagcctttcgaaagaaagattaatgcccgatggtctgtgattgagacatctcgattacagtaaagatttatcggcgatggatgaggatgcgtccgattaggtagtaggcggggtaacggcccacctagccgacgatcggtaggggttctgagaggaag

SEQ ID NO: 5629 - DNA, 301 bp, Unknown
  Ascusbbf_983757B, encodes 16S rRNA
agagtttgatcatggctcaggatgaacgctagctacaggcttaacacatgcaagtcgaggggcagcatgaaggtagcaatacctttgatggcgaccggcgcacgggtgcgtaacacgtatccaatctacccatggctcgggaatagcctttcgaaagaaagattaatgcccgatggtctgtgattgagacatctcgattacagtaaagatttatcggcgatggatgaggatgcgtccgattaggtagtaggcggggtaacggcccacctagccgacgatcggtaggggttctgagaggaag

SEQ ID NO: 5630 - DNA, 301 bp, Unknown
  Ascusbbf_983757C, encodes 16S rRNA
agagtttgatcctggctcaggatgaacgctagctacaggcttaacacatgcaagtcgaggggcagcatgagggtagcaatacctttgatggcgaccggcgcacgggtgcgtaacacgtatccaatctacccatggctcgggaatagcctttcgaaagaaagattaatgcccgatggtctgtgattgagacatctcgattacagtaaagatttatcggcgatggatgaggatgcgtccgattaggtagtaggcggggtaacggcccacctagccgacgatcggtaggggttctgagaggaag

SEQ ID NO: 5631 - DNA, 298 bp, Unknown; identical to SEQ ID NO: 5480
  Ascusbbf_52330A, encodes 16S rRNA

SEQ ID NO: 5632 - DNA, 300 bp, Unknown
  Ascusbbf_1085A, encodes 16S rRNA
agagtttgatcatggctcaggatgaacgctggcggcgtgcttaacacatgcaagtcgagcgaagcacggaaacggatttcttcggactgaaggttctgtgactgagcggcggacgggtgagtaacgcgtggggaacctgccctgtaccgggggataacagacagaaatgtctgctaataccgcataagcgcacgagaaggcatcttcttgtgtgaaaaactccggtggtacaggatggacccgcgttggattagccagttggcggggtaacggcccaccaaagcgacgatccatagccgg

SEQ ID NO: 5633 - DNA, 300 bp, Unknown
  Ascusbbf_1085B, encodes 16S rRNA
agagtttgatcctggctcaggatgaacgctggcggcgtgcttaacacatgcaagtcgagcgaagcgcagaaacggatttcttcggattgaaggttctgtgactgagcggcggacgggtgagtaacgcgtggggaacctgccctgtaccgggggataacagacagaaatgtctgctaataccgcataagcgcacgagaaggcatcttcttgtgtgaaaaactccggtggtacaggatggacccgcgttggattagccagttggcggggtaacggcccaccaaagcgacgatccatagccgg

SEQ ID NO: 5634 - DNA, 300 bp, Unknown
  Ascusbbf_1085C, encodes 16S rRNA
agagtttgatcctggctcaggatgaacgctggcggcgtgcttaacacatgcaagtcgagcgaagcacagaaacggatttcttcggattgaaggttctgtgactgagcggcggacgggtgagtaacgcgtggggaacctgccctgtaccgggggataacagacagaaatgtctgctaataccgcataagcgcacgagaaggcatctttttgtgtgaaaaactccggtggtacaggatggacccgcgttggattagccagttggcggggtaatggcccaccaaagcgacgatccatagccgg

SEQ ID NO: 5635 - DNA, 300 bp, Unknown
  Ascusbbf_1085D, encodes 16S rRNA
agagtttgatcctggctcaggatgaacgctggcggcgtgcttaacacatgcaagtcgagcgaagcacggaaacggatttcttcggattgaaggttctgtgactgagcggcggacgggtgagtaacgcgtggggaacctgccctgtaccgggggataacagacagaaatgtctgctaataccgcataagcgcacgagaaggcatcttcttgtgtgaaaaactccggtggtacaggatggacccgcgttggattagccagttggcggggtaacggcccaccaaagcgacgatccatagccgg

SEQ ID NO: 5636 - DNA, 300 bp, Unknown
  Ascusbbf_1085E, encodes 16S rRNA
agagtttgatcatggctcaggatgaacgctggcggcgtgcttaacacatgcaagtcgagcgaagcgcagaaacggatttcttcggattgaaggttctgtgactgagcggcggacgggtgagtaacgcgtggggaacctgccctgtaccgggggataacagacagaaatgtctgctaataccgcataagcgcacgagaaggcatcttcttgtgtgaaaaactccggtggtacaggatggacccgcgttggattagccagttggcggggtaacggcccaccaaagcgacgatccatagccgg

SEQ ID NO: 5637 - DNA, 300 bp, Unknown
  Ascusbbf_1085F, encodes 16S rRNA
agagtttgatcatggctcaggatgaacgctggcggcgtgcttaacacatgcaagtcgagcgaagcacagaaacggatttcttcggaataaaggttctgtgactgagcggcggacgggtgagtaacgcgtggggaacctgccctgtaccgggggataacagacagaaatgtctgctaataccgcataagcgcatgagaaggcatcttcttgtgtgaaaaactccggtggtacaggatggacccgcgttggattagccagttggcggggtaacggcccaccaaagcgacgatccatagccgg

SEQ ID NO: 5638 - DNA, 300 bp, Unknown
  Ascusbbf_1085G, encodes 16S rRNA
agagtttgatcatggctcaggatgaacgctggcggcgtgcttaacacatgcaagtcgagcgaagcgcttaaccggatttcttcggattgaaggttttgtgactgagcggcggacgggtgagtaacgcgtggggaacctgccctgtaccgggggataacagacagaaatgtctgctaatactgcataagcgcacgaaaaggcatctttttgtgtgaaaaactccggtggtacaggatggacccgcgttggattagccagttggcggggtaacggcccaccaaagcgacgatccatagccgg

SEQ ID NO: 5639 - DNA, 300 bp, Unknown
  Ascusbbf_1085H, encodes 16S rRNA
agagtttgatcctggctcaggatgaacgctggcggcgtgcttaacacatgcaagtcgagcgaagcgcttaaccggatttcttcggattgaaggttttgtgactgagcggcggacgggtgagtaacgcgtggggaacctgccctgtaccgggggataacagacagaaatgtctgctaataccgcataagcgcacgaaaaggcatctttttgtgtgaaaaactccggtggtacaggatggacccgcgttggattagccagttggcggggtaacggcccaccaaagcgacgatccatagccgg

SEQ ID NO: 5640 - DNA, 300 bp, Unknown
  Ascusbbf_1085I, encodes 16S rRNA
agagtttgatcatggctcaggatgaacgctggcggcgtgcttaacacatgcaagtcgagcgaagcgctcaaccggatttcttcggattgaaggttttgcgactgagcggcggacgggtgagtaacgcgtggggaacctgccctgtaccgggggataacagacagaaatgtctgctaataccgcataagcgcacgagaaggcatctttttgtgtgaaaaactccggtggtacaggatggacccgcgttggattagccagttggcggggtaacggcccaccaaagcgacgatccatagccgg

SEQ ID NO: 5641 - DNA, 300 bp, Unknown
  Ascusbbf_1085J, encodes 16S rRNA
agagtttgatcctggctcaggatgaacgctggcggcgtgcttaacacatgcaagtcgagcgaagcacagaaacggatttcttcggattgaaggttctgtgactgagcggcggacgggtgagtaacgcgtggggaacctgccctgtaccgggggataacagacagaaatgtctgctaataccgcataagcgcacgagaaggcatctttttgtgtgaaaaactccggtggtacaggatggacccgcgttggattagccagttggcggggtaacggcccaccaaagcgacgatccatagccgg

SEQ ID NO: 5642 - DNA, 300 bp, Unknown; identical to SEQ ID NO: 5636
  Ascusbbf_1085K, encodes 16S rRNA

SEQ ID NO: 5643 - DNA, 225 bp, Unknown
  Ascusbbf_154A, encodes 16S rRNA
agagtttgatcctggctcagattgaacgctggcggcaggcctaatacatgcaagtcgaacggtaacataggaaaagcttgcttttcctgatgacgagtggcggacgggtgagtaaagtttgggaagttacctgatagagggggacaacagttggaaacgactgctaataccgcatacagcctgagggtgaaagcagcaatgcgctatcagatgcgcccaaatggg

SEQ ID NO: 5644 - DNA, 301 bp, Unknown
  Ascusbbf_154B, encodes 16S rRNA
agagtttgatcctggctcagattgaacgctggcggcaggcctaatacatgcaagtcgaacggtaacataggaaaagcttgcttttcctgatgacgagtggcggacgggtgagtaaagtttgggaagctacctgatagagggggacaacagttggaaacgactgctaataccgcatacagcctgagggtgaaagcagcaatgcgctatcagatgcgcccaaatgggattagctagtaggtgaggtaaaggctcacctaggcgacgatctctagctggtctgagaggatgatcagccacattg

SEQ ID NO: 5645 - DNA, 301 bp, Unknown
  Ascusbbf_154D, encodes 16S rRNA
agagtttgatcctggctcagattgaacgctggcggcaggcctaatacatgcaagtcgaacggtaacataggaaaagcttgcttttcctgatgacgagtggcggacgggtgagtaaagtttgggaagctacctgatagagggggacaacagttggaaacgactgctaataccgcatacagcctgagggtgaaagcagcaatgcgctatcagatgcgcccaaatgggattagctagtaggtgaggtaaaggctcacctaggcgacgatcagtagccgacctgagagggtgaccggccacattg

SEQ ID NO: 5646 - DNA, 301 bp, Unknown
  Ascusbbf_154E, encodes 16S rRNA
agagtttgatcatggctcagattgaacgctggcggcaggcctaatacatgcaagtcgaacggtaacataagaaagcttgctttcttgatgacgagtggcggacgggtgagtaatatttgggaagctacctgatagagggggacaacagttggaaacgactgctaataccgcatacagcctgagggtgaaagcagcaatgcgctatcagatgcgcccaaacgggattagctagtaggtgaggtaaaggctcacctaggcgacgatctctagctggtctgagaggatgatcagccacattggg

SEQ ID NO: 5647 - DNA, 301 bp, Unknown
  Ascusbbf_154F, encodes 16S rRNA
agagtttgatcctggctcagattgaacgctggcggcaggcctaatacatgcaagtcgaacggtaacataagaaagcttgctttcttgatgacgagtggcggacgggtgagtaatatttgggaagctacctgatagagggggacaacagttggaaacgactgctaataccgcatacagcctgagggtgaaagcagcaatgcgctatcagatgcgcccaaacgggattagctagtaggtgaggtaaaggctcacctaggcgacgatctctagctggtctgagaggatgatcagccacattggg

SEQ ID NO: 5648 - DNA, 301 bp, Unknown
  Ascusbbf_154G, encodes 16S rRNA
agagtttgatcatggctcagattgaacgctggcggcaggcctaatacatgcaagtcgaacggtaacataggaaaagcttgcttttcctgatgacgagtggcggacgggtgagtaaagtttgggaagctacctgatagagggggacaacagttggaaacgactgctaataccgcatacagcctgagggtgaaagcagcaatgcgctatcagatgcgcccaaatgggattagctagtaggtgaggtaaaggctcacctaggcgacgatctctagctggtctgagaggatgatcagccacattg

SEQ ID NO: 5649 - DNA, 301 bp, Unknown
  Ascusbbf_154H, encodes 16S rRNA
agagtttgatcctggctcagattgaacgctggcggcaggcctaatacatgcaagtcgaacggtaacataggaaaagcctgcttttcctgatgacgagtggcggacgggtgagtaaagtttgggaagttacctgatagagggggacaacagttggaaacgactgctaataccgcatacagcctgagggtgaaagcagcaatgcgctatcagatgcgcccaaatgggattagctagtaggtgaggtaaaggctcacctaggcgacgatctctagctggtctgagaggatgatcagccacattg

SEQ ID NO: 5650 - DNA, 301 bp, Unknown
  Ascusbbf_154I, encodes 16S rRNA
agagtttgatcatggctcagattgaacgctggcggcaggcctaatacatgcaagtcgaacggtaacataggaaaagcttgcttttcctgatgacgagtggcggacgggtgagtaagatttgggaagctacctgatagagggggacaacagttggaaacgactgctaataccgcatacagcctgagggtgaaagcagcaatgcgctatcagatgcgcccaaatgggattagctagtaggtgaggtaaaggctcacctaggcgacgatctctagctggtctgagaggatgatcagccacattg

SEQ ID NO: 5651 - DNA, 300 bp, Unknown
  Ascusbbf_154M, encodes 16S rRNA
agagtttgatcctggctcagattgaacgctggcggcaggcctaatacacgcaagtcgaacggtaacataggaaaagcttgcttttcctgatgacgagtggcggacgggtgagtaaagtttgggaagttacctgatagagggggacaacagttggaaacgactgctaataccgcatacagcctgagggtgaaagcagcaatgcgctatcagatgcgcccaaatgggattagctagtaggtgaggtaaaggctcacctaggcgacgatctctagctggtctgagaggatgatcagccacatt

SEQ ID NO: 5652 - DNA, 225 bp, Unknown
  Ascusbbf_1010A, encodes 16S rRNA
agagtttgatcatggctcaggacgaacgctggcggcgtgcttaacacatgcaagtcgaacgagacgatttagaagcttgcttttattgagtcgagtggcaaacgggtgagtaacgcgtagacaacctgccgcaaagatggggacaacagtccgaaaggactgctaataccgaatgttgtatctcctccgcatggaagagatattaaagatggcctctacttgtaa

SEQ ID NO: 5653 - DNA, 301 bp, Unknown
  Ascusbbf_1010B, encodes 16S rRNA
agagtttgatcctggctcaggacgaacgctggcggcgtgcttaacacatgcaagtcgaacgagacgatttagaagcttgcttttattgagtcgagtggcaaacgggtgagtaacgcgtagacaacctgccgcaaagatggggacaacagtccgaaaggactgctaataccgaatgttgtatctcctccgcatggaagagatattaaagatggcctctacttgtaagctatcgctttgcgatgggtctgcgtctgattagctagttggtggggcaacggcctaccaaggcgacgatcagtag

SEQ ID NO: 5654 - DNA, 301 bp, Unknown; identical to SEQ ID NO: 5413
  Ascusbbf_1010C, encodes 16S rRNA

SEQ ID NO: 5655 - DNA, 301 bp, Unknown
  Ascusbbf_1010D, encodes 16S rRNA
agagtttgatcctggctcaggacgaacgctggcggcgtgcttaacacatgcaagtcgaacgagacgatttagaagcttgcttttattgagtcgagtggcaaacgggtgagtaacgcgtagacaacctgccgcaaagatggggacaacagtccgaaaggactgctaataccgaatgttgtatctcctccgcatgaaagagatattaaagatggcctctacttgtaagctatcgctttgcgatgggtctgcgtctgattagctagttggtggggcaacggcctaccaaggcgacgatcagtag

SEQ ID NO: 5656 - DNA, 301 bp, Unknown
  Ascusbbf_1010E, encodes 16S rRNA
agagtttgatcatggctcaggacgaacgctggcggcgtgcttaacacatgcaagtcgaacgagacgaattagaagcttgcttttgacgagtcgagtggcaaacgggtgagtaacgcgtagacaacctgccgcaaagatggggacaacagtccgaaaggactgctaataccgaatgttgtatctcctccgcatggaagagatattaaagatggcctctacttgtaagctatcgctttgcgatgggtctgcgtctgattagctagttggtggggcaacggcctaccaaggcgacgatcagtag

SEQ ID NO: 5657 - DNA, 301 bp, Unknown
  Ascusbbf_1010F, encodes 16S rRNA
agagtttgatcctggctcagaacgaacgctggcggcaggtcttaggcatgcaagtcgaacgagacgatttagaagcttgcttttattgagtcgagtggcaaacgggtgagtaacgcgtagacaacctgccgcaaagatggggacaacagtccgaaaggactgctaataccgaatgttgtatctcctccgcatggaagagatatcaaagatggcctctacttgtaagctatcgctttgcgatgggtctgcgtctgattagctagttggtggggcaacggcctaccaaggcgacgatcagtag

SEQ ID NO: 5658 - DNA, 301 bp, Unknown; identical to SEQ ID NO: 5577
  Ascusbbf_1010G, encodes 16S rRNA

SEQ ID NO: 5659 - DNA, 301 bp, Unknown
  Ascusbbf_1010H, encodes 16S rRNA
agagtttgatcatggctcaggacgaacgctggcggcgtgcttaacacatgcaagtcgaacgagacgatttagaagcttgcttttattgagtcgagtggcaaacgggtgagtaacgcgtagacaacctgccgcaaagatggggacaacagtccgaaaggactgctaataccgaatgttgtgtatcctccgcatggaggacgcattaaagatggcctctacttgtaagctatcgctttgcgatgggtctgcgtctgattagctagttggtggggcaacggcctaccaaggcgacgatcagtag

SEQ ID NO: 5660 - DNA, 301 bp, Unknown; identical to SEQ ID NO: 5549
  Ascusbbf_1010I, encodes 16S rRNA

SEQ ID NO: 5661 - DNA, 301 bp, Unknown
  Ascusbbf_1010J, encodes 16S rRNA
agagtttgatcctggctcaggacgaacgctggcggcgtgcttaacacatgcaagtcgaacgagacgaattagaagcttgcttttgacgagtcgagtggcaaacgggtgagtaacgcgtagacaacctgccgcaaagatggggacaacagtccgaaaggactgctaataccgaatgttgtatctcctccgcatggaagagatattaaagatggcctctacttgtaagctatcgctttgcgatgggtctgcgtctgattagctagttggtggggcaacggcctaccaaggcgacgatcagtag

SEQ ID NO: 5662 - DNA, 225 bp, Unknown
  Ascusbbf_5575A, encodes 16S rRNA
agagtttgatcctggctcaggacgaacgctggcggcgtgcttaacgcatgcaagtcgaacgagaagagatgagaagcttgcttcttatcaattcgagtggcaaacgggcgagtaacgcgtaagcaacctacccttcagatggggacaacagctggaaacggctgctaataccgaatacgttctttttgtcgcatggcagagggaagaaaggaaggctcttcggag

SEQ ID NO: 5663 - DNA, 225 bp, Unknown
  Ascusbbf_5575B, encodes 16S rRNA
agagtttgatcctggctcaggacgaacgctggcggcgtgcttaacacatgcaagtcgaacgagaagagatgagaagcttgcttcttatcaattcgagtggcaaacgggtgagtaacgcgtaagcaacctgccctctagatggggacaacagctggaaacggctgctaataccgaatacgttttttctgtcgcatggcagagggaagaaagggaggctcttcggag

SEQ ID NO: 5664 - DNA, 300 bp, Unknown
  Ascusbbf_5575C, encodes 16S rRNA
agagtttgatcctggctcaggacgaacgctggcggcgtgcttaacacatgcaagtcgaacgagaagagatgagaagcttgcttcttattgatttgagtggcaaacgggtgagtaacgcgtaagcaacctgcccttcagatggggacaacagctggaaacggctgctaataccgaatacgttctctctgccgcatgacagagggaagaaagggaggctctttggagctttcgctggaggagggacttgcgtctgattagctagttggaggggtaacggcccaccaaggcgacgatcagtag

SEQ ID NO: 5665 - DNA, 300 bp, Unknown; identical to SEQ ID NO: 5586
  Ascusbbf_5575D, encodes 16S rRNA

SEQ ID NO: 5666 - DNA, 300 bp, Unknown; identical to SEQ ID NO: 5585
  Ascusbbf_5575E, encodes 16S rRNA

SEQ ID NO: 5667 - DNA, 300 bp, Unknown; identical to SEQ ID NO: 5580
  Ascusbbf_5575F, encodes 16S rRNA

SEQ ID NO: 5668 - DNA, 300 bp, Unknown; identical to SEQ ID NO: 5578
  Ascusbbf_5575G, encodes 16S rRNA

SEQ ID NO: 5669 - DNA, 300 bp, Unknown
  Ascusbbf_5575H, encodes 16S rRNA
agagtttgatcctggctcaggacgaacgctggcggcgtgcttaacacatgcaagtcgaacgagaagagatgagaagcttgcttcttatcgattcgagtggcaaacgggtgagtaacgcgtaagcaacctgcccttcagatggggacaacagctggaaacggctgctaataccgaatacgttctttttgtcgcatggcagagggaagaaagggaggctcttcggagctttcgctgaaggaggggcttgcgtctgattagctagttggaggggtaacggcccaccaaggcgacgatcagtag

SEQ ID NO: 5670 - DNA, 301 bp, Unknown
  Ascusbbf_775A, encodes 16S rRNA
agagtttgatcctggctcaggatgaacgctagcgacaggcctaacacatgcaagtcgaggggcagcgcgggagaagcttgcttttcctggcggcgaccggcgcacgggtgcgtaacaggtgtgcaatctgtcctataccggggcatagcccagcgaaagttggattaattctccatgtgagcgagtgccgcatgacacacgcttgaaacgtaagggtatagggtgagcacgcttctgattagatagttggtggggtaacggctcaccaagtcgacgatcagtaggggttctgagaggaagg

SEQ ID NO: 5671 - DNA, 301 bp, Unknown
  Ascusbbf_775B, encodes 16S rRNA
agagtttgatcatggctcaggatgaacgctagcgacaggcctaacacatgcaagtcgaggggcagcgcgggagaagcttgcttttcctggcggcgaccggcgcacgggtgcgtaacaggtgtgcaatctgtcctataccggggcatagcccagcgaaagttggattaattctccatgtgagcgagtgccgcatgacacacgcttgaaacgtaagggtatagggtgagcacgcttctgattagatagttggtggggtaacggctcaccaagtcgacgatcagtaggggttctgagaggaagg

SEQ ID NO: 5672 - DNA, 300 bp, Unknown
  Ascusbbf_24302A, encodes 16S rRNA
agagtttgatcatggctcaggacgaacgctggcggcgtgcttaacacatgcaagtcgagcgatgaagctccttcgggagcggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcgg

SEQ ID NO: 5673 - DNA, 300 bp, Unknown
  Ascusbbf_24302B, encodes 16S rRNA
agagtttgatcctggctcaggacgaacgctggcggcgtgcttaacacatgcaagtcgagcgatgaagttccttcgggagtggattagcggcggacgggtgagtaacacgtgggtaacctgcctcatagaggggaatagcctttcgaaaggaagattaataccgcataagattgtagtgccgcatggtacagcaattaaaggagtaatccgctatgagatggacccgcgtcgcattagctagttggtgaggtaacggctcaccaaggcgacgatgcgtagccgacctgagagggtgatcgg

SEQ ID NO: 5674 - DNA, 301 bp, Unknown
  Ascusbbf_24302C, encodes 16S rRNA
agagtttgatcatggctcaggatgaacgctggcggcgtgcttaacacatgcaagtcgagcgatgaagctccttcgggagtggattagcggcggacgggtgagtaacacgtgggtaacctgcctcatagaggggaatagccttccgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcggg

SEQ ID NO: 5675 - DNA, 300 bp, Unknown
  Ascusbbf_24302D, encodes 16S rRNA
agagtttgatcctggctcaggacgaacgctggcggcgtgcttaacacatgcaagtcgagcgatgaagttccttcgggaatggattagcggcggacgggtgagtaacacgtgggtaacctgcctcgtagaggggaatagccttccgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcgg

SEQ ID NO: 5676 - DNA, 300 bp, Unknown
  Ascusbbf_24302E, encodes 16S rRNA
agagtttgatcctggctcaggacgaacgctggcggcgtgcttaacacatgcaagtcgagcgatgaagctccttcgggagtgaattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcgg

SEQ ID NO: 5677 - DNA, 300 bp, Unknown
  Ascusbbf_24302F, encodes 16S rRNA
agagtttgatcctggctcaggacgaacgctggcggcgtgcttaacacatgcaagtcgagcgatgaagttccttcgggaacggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcgg

SEQ ID NO: 5678 - DNA, 300 bp, Unknown
  Ascusbbf_24302G, encodes 16S rRNA
agagtttgatcctggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcgg

SEQ ID NO: 5679 - DNA, 300 bp, Unknown
  Ascusbbf_24302H, encodes 16S rRNA
agagtttgatcctggctcaggacgaacgctggcggcgtgcttaacacatgcaagtcgagcgatgaagcttcttcggaagtggattagcggcggacgggtgagtaacacgtgggtaacctgcctcatagaggggaatagcctttcgaaaggaagattaataccgcataagattgtagtaccgcatggtacagcaattaaaggagtaatccgctatgagatggacccgcgtcgcattagctagttggtgaggtaacggctcaccaaggcgacgatgcgtagccgacctgagagggtgatcgg

SEQ ID NO: 5680 - DNA, 300 bp, Unknown
  Ascusbbf_24302I, encodes 16S rRNA
agagtttgatcatggctcaggacgaacgctggcggcgtgcttaacacatgcaagtcgagcgatgaagctccttcgggagtggattagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcgg

SEQ ID NO: 5681 - DNA, 301 bp, Unknown
  Ascusbbf_24302J, encodes 16S rRNA
agagtttgatcatggctcaggacgaacgctggcggcgtgcttaacacatgcaagtcgagcgagatgaactccttcgggagggactctagcggcggacgggtgagtaacacgtgggtaacctgcctcatagaggggaatagcctttcgaaaggaagattaataccgcataagattgtagtgccgcatggcatagcaattaaaggagtaatccgctatgagatggacccgcgtcgcattagctagttggtgaggtaacggctcaccaaggcgacgatgcgtagccgacctgagagggtgatcg

SEQ ID NO: 5682 - DNA, 301 bp, Unknown
  Ascusbbf_1A, encodes 16S rRNA
agagtttgatcatggctcagattgaacgctggcggcaggcctaatacatgcaagtcggacggtaacataagaaaagcttgcttttcttgatgacgagtggcggacgggcgagtaagatttgggaagctacctgatagagggggacaacagttggaaacgactgctaataccgcatacagccttagggtgaaagaagaaattcgctatcagatgtgcccaaacgggattagctagtaggtgaggtaaaggctcacctaggcgacgatctctagctggtctgagaggatgatcagccacattg

SEQ ID NO: 5683 - DNA, 301 bp, Unknown
  Ascusbbf_1B, encodes 16S rRNA
agagtttgatcatggctcagattgaacgctggcggcaggcctaatacatgcaagtcgaacggtaacataagaaaagcttgcttttcttgatgacgagtggcggacgggtgagtaacatttgggaaactacctgatagagggggacaacagttggaaacgactgctaataccgcatacagcctaagggtgaaagaagcaattcgctatcagatgtgcccaaacgggattagctagtaggtgaggtaaaggctcacctaggcgatgatctctagctggtctgagaggatgatcagccacattg

SEQ ID NO: 5684 - DNA, 301 bp, Unknown
  Ascusbbf_1C, encodes 16S rRNA
agagtttgatcctggctcagattgaacgctggcggcaggcctaatacatgcaagtcgaacggtaacataagaaaagcttgcttttcttgatgacgagtggcggacgggtgagtaagatttgggaaactacctgatagagggggacaacagttggaaacgactgctaataccgcatacagccttagggtgaaagaagaaattcgctatcagatgtgcccaaatgggattagctagtaggtgaggtaaaggctcacctaggcgacgatctctagctggtctgagaggatgatcagccacattg

SEQ ID NO: 5685 - DNA, 301 bp, Unknown; identical to SEQ ID NO: 5647
  Ascusbbf_1D, encodes 16S rRNA

SEQ ID NO: 5686 - DNA, 300 bp, Unknown
  Ascusbbf_1E, encodes 16S rRNA
agagtttgatcatggctcagattgaacgctggcggcaggcctaatacatgcaagtcgaacggtaacataaaagaagcttgcttcttttgatgacgagtggcggacgggtgagtaatatttgggaaactacctgatagagggggacaacagttggaaacgactgctaataccgcataaagcctaagggtgaaagcagcaatgcgctatcagatgtgcccaaacgggattagctagtaggtgaggtaaaggctcacctaggcgacgatctctagctggtctgagaggatgatcagccacatt

SEQ ID NO: 5687 - DNA, 301 bp, Unknown
  Ascusbbf_1F, encodes 16S rRNA
agagtttgatcatggctcagattgaacgctggcggcaggcctaatacatgcaagtcgaacggtaacataagaaaagcttgcttttcttgatgacgagtggcggacgggtgagtaagatttgggaaactacctgatagagggggacaacagttggaaacgactgctaataccgcatacagccttagggtgaaagaagaaattcgctatcagatgtgcccaaatgggattagctagtaggtgaggtagaggctcacctaggcgacgatctctagctggtctgagaggatgatcagccacattg

SEQ ID NO: 5688 - DNA, 301 bp, Unknown
  Ascusbbf_1G, encodes 16S rRNA
agagtttgatcctggctcagattgaacgctggcggcaggcctaatacatgcaagtcgaacggtaacataagaaaagcttgcttttcttgatgacgagtggcggacgggtgagtaacatttgggaaactacctgatagagggggacaacagttggaaacgactgctaataccgcatacagcctaagggtgaaagaagcaattcgctatcagatgtgcccaaacgggattagctagtaggtgaggtaaaggctcacctaggcgatgatctctagctggtctgagaggatgatcagccacattg

SEQ ID NO: 5689 - DNA, 300 bp, Unknown
  Ascusbbf_1H, encodes 16S rRNA
agagtttgatcctggctcagattgaacgctggcggcaggcctaatacatgcaagtcgaacggtaacataagaaaagcttgcttttcttgatgacgagtggcggacgggtgagtaacatttgggaaactacctgatagagggggacaacagttggaaacgactgctaataccgcatatagcctaagggtgaaagaagtaattcgctatcagatgtgcccaaacgggattagctagtaggtgaggtaaaggctcacctaggcgatgatctctagctggtctgagaggatgatcagccacatt

SEQ ID NO: 5690 - DNA, 301 bp, Unknown
  Ascusbbf_1I, encodes 16S rRNA
agagtttgatcctggctcagattgaacgctggcggcaggcctaatacatgcaagtcggacggtaacataagaaaagcttgcttttcttgatgacgagtggcggacgggtgagtaagatttgggaagctacctgatagagggggacaacagttggaaacgactgctaataccgcatacagcctcagggtgaaagaagcgattcgctatcagatgtgcccaaacgggattagctagtaggtgaggtaaaggctcacctaggcgacgatctctagctggtctgagaggatgatcagccacattg

SEQ ID NO: 5691 - DNA, 301 bp, Unknown
  Ascusbbf_1J, encodes 16S rRNA
agagtttgatcatggctcagattgaacgctggcggcaggcctaatacatgcaagtcgaacggtaacataagaaaagcttgcttttcttgatgacgagtggcggacgggtgagtaacatttgggaaactacctgatagagggggacaacagttggaaacgactgctaataccgcatatagcctaagggtgaaagaagtaattcgctatcagatgtgcccaaacgggattagctagtaggtgaggtaaaggctcacctaggcgatgatctctagctggtctgagaggatgatcagccacattg

SEQ ID NO: 5692 - DNA, 301 bp, Unknown
  Ascusbbf_1K, encodes 16S rRNA
agagtttgatcctggctcagattgaacgctggcggcaggcctaatacatgcaagtcgaacggtaacataagaaaagcttgcttttcttgatgacgagtggcggacgggtgagtaagatttgggaaactacctgatagagggggacaacagttggaaacgactgctaataccgcatacagccttagggtgaaagaagaaattcgctatcagatgtgcccaaacgggattagctagtaggtgaggtaaaggctcacctaggcgacgatctctagctggtctgagaggatgatcagccacattg

SEQ ID NO: 5693 - DNA, 300 bp, Unknown
  Ascusbbf_52548A, encodes 16S rRNA
agagtttgatcatggctcaggatgaacgctggcggcgtgcttaacacatgcaagtcgaacgaagcgcattgtttgaattcttcggaaggaagataatgtgactgagtggcggacgggtgagtaacgcgtgggtaacctgccatgtacagggggacaacagttggaaacggctgctaataccgcataagcgcacgagattgcatgatctagtgtgaaaaactccggtggtatatgatggacccgcgtctgattagctagttggtaaggtaacggcttaccaaggcgacgatcagtagccga

SEQ ID NO: 5694 - DNA, 300 bp, Unknown
  Ascusbbf_52548B, encodes 16S rRNA
agagtttgatcctggctcaggatgaacgctggcggcgtgcttaacacatgcaagtcgaacgaagcgcattgtttgaattcttcggaaggaagataatgtgactgagtggcggacgggtgagtaacgcgtgggtaacctgccatgtacagggggacaacagttggaaacggctgctaataccgcataagcgcacgagattgcatgatctagtgtgaaaaactccggtggtatatgatggacccgcgtctgattagctagttggtaaggtaacggcttaccaaggcgacgatcagtagccga

SEQ ID NO: 5695 - DNA, 300 bp, Unknown
  Ascusbbf_50658A, encodes 16S rRNA
agagtttgatcatggctcaggacgaacgctggcggcgtgcctaacacatgcaagtcgagcggagacatacagcggataggaagttttcggatggaattgaagaagtatgttttagcggcggacgggtgagtaacgcgtgagcaatctgtccttcacagggggataacacagcgaaagttgtactaataccgcataagaccacggtgttgcatgacacaggggtcaaaggaggaatccggtgaagggtgagctcgcgtccgattagatagtaggtgaggtaacggcccacctagtcgacga

SEQ ID NO: 5696 - DNA, 225 bp, Unknown
  Ascusbbf_850A, encodes 16S rRNA
agagtttgatcatggctcaggataaacgctggcggcgtgcttaacacatgcaagtcgaacgaggaacagaagacgaggtcttcggattaaattgactgttccgagtggcggacgggtgagtaacgcgtggggaacctgccttatactgagggacaacagctggaaacggctgctaatacctcatatgcgcacaggaaggcatcttccggtgtggaaagaaattcg

SEQ ID NO: 5697 - DNA, 300 bp, Unknown
  Ascusbbf_850B, encodes 16S rRNA
agagtttgatcctggctcaggataaacgctggcggcgtgcttaacacatgcaagtcgaacgaggaacagaagacgaggtcttcggattaaattgactgttccgagtggcggacgggtgagtaacgcgtggggaacctgccttatactgagggacaacagctggaaacggctgctaatacctcatatgcgcacaggaaggcatcttccggtgtggaaagaaattcggtataagatggccccgcgtctgattaggcagttggtgagataacagcccaccaaaccgacgatcagtagccgacc

SEQ ID NO: 5698 - DNA, 298 bp, Unknown
  Ascusbbf_850C, encodes 16S rRNA
agagtttgatcatggctcaggataaacgctggcggcgtgcttaacacatgcaagtcgaacgaggaacagaagacgagatcttcggatcaaattgactgttccgagtggcggacgggtgagtaacgcgtggggaacctgccttatactgagggacaacagctggaaacggctgctaatacctcatatgcgcacaggaaggcatcttccggtgtggaaagaaattcggtataagatggccccgcgtctgattaggcagttggtgagataacagcccaccaaaccgacgatcagtagccga

SEQ ID NO: 5699 - DNA, 298 bp, Unknown
  Ascusbbf_850D, encodes 16S rRNA
agagtttgatcctggctcaggataaacgctggcggcgtgcttaacacatgcaagtcgaacgaggaacagaagatgaggtcttcggattaaattgactgttccgagtggcggacgggtgagtaacgcgtggggaacctgccttatactgagggacaacagctggaaacggctgctaatacctcatatgcgcacaggaaggcatcttccggtgtggaaagaaattcggtataagatggccccgcgtctgattaggcagttggtgagataacagcccaccaaaccgacgatcagtagccga

SEQ ID NO: 5700 - DNA, 298 bp, Unknown
  Ascusbbf_850E, encodes 16S rRNA
agagtttgatcatggctcaggataaacgctggcggcgtgcttaacacatgcaagtcgaacgaggaacagaagacgaggtcttcggattaaattgactgttccgagtggcggacgggtgagtaacgcgtggggaacctgccttatactgagggacaacagctggaaacggctgctaatacctcatatgcgcacaggaaggcatcttccggtgtggaaagaaattcggtataagatggccccgcgtctgattaggcagttggtgagataacagcccaccaaaccgacgatcagtagccga

SEQ ID NO: 5701 - DNA, 298 bp, Unknown
  Ascusbbf_850F, encodes 16S rRNA
agagtttgatcatggctcaggataaacgctggcggcgtgcttaacacatgcaagtcgaacgaggaacagaagacgaggtcttcggatcaaattgactgttccgagtggcggacgggtgagtaacgcgtggggaacctgccttatactgagggacaacagctggaaacggctgctaatacctcatatgcgcacaggaaggcatcttccggtgtggaaagaaattcggtataagatggccccgcgtctgattaggcagttggtgagataacagcccaccaaaccgacgatcagtagccga

SEQ ID NO: 5702 - DNA, 298 bp, Unknown
  Ascusbbf_850G, encodes 16S rRNA
agagtttgatcctggctcaggataaacgctggcggcgtgcttaacacatgcaagtcgaacgaggaacagaagacgaggtcttcggattaaattgactgttccgagtggcggacgggtgagtaacgcgtggggaacctgccttatactgagggacaacagctggaaacggctgctaatacctcatatgcgcacaggaaggcatcttccggtgtggaaagaaattcggtataagatggccccgcgtctgattaggcagttggtgagataacagcccaccaaaccgacgatcagtagccga

SEQ ID NO: 5703 - DNA, 298 bp, Unknown
  Ascusbbf_850H, encodes 16S rRNA
agagtttgatcctggctcaggataaacgctggcggcgtgcttaacacatgcaagtcgaacgagggacagaagacgagatctttggattaaattgactgtttcgagtggcggacgggtgagtaacgcgtggggaacctgccttatactgagggacaacagctggaaacggctgctaatacctcatatgcgcacaggaaggcatcttccggtgtggaaagaaattcggtataagatggccccgcgtctgattaggcagttggtgagataacagcccaccaaaccgacgatcagtagccga

SEQ ID NO: 5704 - DNA, 298 bp, Unknown
  Ascusbbf_850I, encodes 16S rRNA
agagtttgatcatggctcaggataaacgctggcggcgtgcttaacacatgcaagtcgaacgagggacagaagacgagatctttggattaaattgactgtttcgagtggcggacgggtgagtaacgcgtggggaacctgccttatactgagggacaacagctggaaacggctgctaatacctcatatgcgcacaggaaggcatcttccggtgtggaaagaaattcggtataagatggccccgcgtctgattaggcagttggtgagataacagcccaccaaaccgacgatcagtagccga

SEQ ID NO: 5705 - DNA, 300 bp, Unknown
  Ascusbbf_850J, encodes 16S rRNA
agagtttgatcatggctcaggataaacgctggcggcgtgcttaacacatgcaagtcgaacgaggaacagaagacgaggtcttcggattaaattgactgttccgagtggcggacgggtgagtaacgcgtggggaacctgccttatactgagggacaacagctggaaacggctgctaatacctcatatgcgcacaggaaggcatcttccggtgtggaaagaaattcggtataagatggccccgcgtctgattaggcagttggtgagataacagcccaccaaaccgacgatcagtagccgacc

SEQ ID NO: 5706 - DNA, 225 bp, Unknown
  Ascusbbf_4A, encodes 16S rRNA
agagtttgatcatggctcaggatgaacgctagctacaggcttaacacatgcaagtcgaggggaaacgacagagagtgcttgcactttttgggcgtcgaccggcgaatgggtgagtaacgcgtatccaacctgcccttgactgagggatagtccagtgaaaactgaattaatacctcatgttctcctcagacggcatcagacgaggagcaaagattaatcggtcaa

SEQ ID NO: 5707 - DNA, 301 bp, Unknown
  Ascusbbf_4B, encodes 16S rRNA
agagtttgatcctggctcaggatgaacgctagctacaggcttaacacatgcaagtcgaggggaaacgacagagagtgcttgcactttttgggcgtcgaccggcgaatgggtgagtaacgcgtatccaacctgcctttgactgagggatagcccagtgaaaactgaattaatacctcatgttctcctcagacggcatcagacgaggagcaaagattaatcggtcaaggatggggatgcgtctgattaggtagtaggcggggtaacggcccacctagccgacgatcagtaggggttctgagag

SEQ ID NO: 5708 - DNA, 301 bp, Unknown
  Ascusbbf_4C, encodes 16S rRNA
agagtttgatcctggctcaggatgaacgctagctacaggcttaacacatgcaagtcgaggggaaacgacatagagtgcttgcactttatgggcgtcgaccggcgaatgggtgagtaacgcgtatccaacctgcccttgactgagggatagcccagtgaaaactgaattaatacctcatgttctcctcagacggcatcagacgaggagcaaagattaatcggtcaaggatggggatgcgtctgattaggtagtaggcggggtaacggcccacctagccgacgatcagtaggggttctgagag

SEQ ID NO: 5709 - DNA, 301 bp, Unknown
  Ascusbbf_4D, encodes 16S rRNA
agagtttgatcctggctcaggatgaacgctagctacaggcttaacacatgcaagtcgaggggaaacgacagagagtgcttgcactttttgggcgtcgaccggcgaatgggtgagtaacgcgtatccaacctgcccttgactgagggatagcccagtgaaaactgaattaatacctcatgttctcctcagacggcatcagacgaggagcaaagattaatcggtcaaggatggggatgcgtctgattaggtagtaggcggggtaacggcccacctagccgacgatcagtaggggttctgagag

SEQ ID NO: 5710 - DNA, 301 bp, Unknown
  Ascusbbf_4E, encodes 16S rRNA
agagtttgatcatggctcaggatgaacgctagccacaggcttaacacatgcaagtcgaggggaaacgacagagagtgcttgcactttttgggcgtcgaccggcgaatgggtgagtaacgcgtatccaacctgcctttgactgagggatagcccagtgaaaactgaattaatacctcatgttctcctcagacggcatcagacgaggagcaaagattaatcggtcaaggatggggatgcgtctgattaggtagtaggcggggtaacggcccacctagccgacgatcagtaggggttctgagag

SEQ ID NO: 5711 - DNA, 301 bp, Unknown; identical to SEQ ID NO: 5577
  Ascusbbf_4F, encodes 16S rRNA

SEQ ID NO: 5712 - DNA, 301 bp, Unknown
  Ascusbbf_4G, encodes 16S rRNA
agagtttgatcctggctcaggatgaacgctagctacaggcttaacacatgcaagtcgaggggaaacgacagagagtgcttgcactttttgggcgtcgaccggcgaatgggtgagtaacgcgtatccaacctgcccttgactgagggatagcccagtgaaaactgaattaatacctcatatcctcctccgacggcatcagacgaggagtaaagatttatcggtcaaggatggggatgcgtctgattaggtagtaggcggggtaacggcccacctagccgacgatcagtaggggttctgagag

SEQ ID NO: 5713 - DNA, 301 bp, Unknown
  Ascusbbf_4H, encodes 16S rRNA
agagtttgatcctggctcaggatgaacgctagctacaggcttaacacatgcaagtcgaggggaaacgacatagagtgcttgcactttatgggcgtcgaccggcgaatgggtgagtaacgcgtatccaacctgcccttgactgagggatagcccagtggaaactgaattaatacctcatgttctcctcagacggcatcagacgaggagcaaagattaatcggtcaaggatggggatgcgtctgattaggtagtaggcggggtaacggcccacctagccgacgatcagtaggggttctgagag

SEQ ID NO: 5714 - DNA, 301 bp, Unknown
  Ascusbbf_4I, encodes 16S rRNA
agagtttgatcctggctcaggatgaacgctagctacaggcttaacacatgcaagtcgaggggaaacgacagagagtgcttgcacactttgggcgtcgaccggcgaatgggtgagtaacgcgtatccaacctgcccttgactgagggatagcccagtgaaaactgaattaatacctcatgttctcctccgacggcatcagacgaggagtaaagattaatcggtcaaggatggggatgcgtctgattaggtagtaggcggggtaacggcccacctagccgacgatcagtaggggttctgagag

SEQ ID NO: 5715 - DNA, 301 bp, Unknown
  Ascusbbf_4J, encodes 16S rRNA
agagtttgatcctggctcaggatgaacgctagctacaggcttaacacatgcaagtcgaggggaaacgacaaagagtgcttgcacactttgggcgtcgaccggcgaatgggtgagtaacgcgtatccaacctgcccttgactgagggatagcccagtgaaaactgaattaatacctcatgtcctcctccgacggcatcagacgaggagtaaagatttatcggtcaaggatggggatgcgtctgattaggtagtaggcggggtaacggcccacctagccgacgatcagtaggggttctgagag

SEQ ID NO: 5716 - DNA, 301 bp, Unknown
  Ascusbbf_4K, encodes 16S rRNA
agagtttgatcctggctcaggatgaacgctagctacaggcttaacacatgcaagtcgaggggaaacgacatagagtgcttgcactttatgggcgtcgaccggcgaatgggtgagtaacgcgtatccaacctgcccttgaccgagggatagcccagtgaaaactgaattaatacctcatgttctcctcagacggcatcagacgaggagcaaagattaatcggtcaaggatggggatgcgtctgattaggtagtaggcggggtaacggcccacctagccgacgatcagtaggggttctgagag

SEQ ID NO: 5717 - DNA, 300 bp, Unknown
  Ascusbbf_5131A, encodes 16S rRNA
agagtttgatcctggctcaggatgaacgctagctacaggcttaacacatgcaagtcgaggggcagcattaagtcagcttgctgatttagatggcgaccggcgcacgggtgagtaacgcgtatccaacctgccccctacccggggatagccttgcgaaagtaagattaatacccggtgctgttatgattccgcatgggaatataacgaaagattcatcggtaggggatggggatgcgtccgattagcttgttggcggggtaacggcccaccaaggcgacgatcggtaggggttctgagagg

SEQ ID NO: 5718 - DNA, 300 bp, Unknown
  Ascusbbf_5131B, encodes 16S rRNA
agagtttgatcatggctcaggatgaacgctggcggcgtgcttaacacatgcaagtcgaacgaagcaacttattacgatcccttcggggtgacgatttgttgactgagtggcggacgggtgagtaacgcgtgggtaacctaccttgtacagggggacaacagttggaaacgactgctaataccgcataagcgcacagcttcgcatgaagcagtgtgaaaagttttttcggtacaagatggacccgcgtctgattagctagttggtgaggtaacggcccaccaaggcgacgatcagtagccg

SEQ ID NO: 5719 - DNA, 300 bp, Unknown
  Ascusbbf_5131C, encodes 16S rRNA
agagtttgatcatggctcaggatgaacgctagctacaggcttaacacatgcaagtcgaggggcagcattaagtcagcttgctgatttagatggcgaccggcgcacgggtgagtaacgcgtatccaacctgccccctacccggggatagccttgcgaaagtaagattaatacccggtgctgttatgattccgcatgggaatataacgaaagattcatcggtaggggatggggatgcgtccgattagcttgttggcggggtaacggcccaccaaggcgacgatcggtagggggtctgagagg

SEQ ID NO: 5720 - DNA, 300 bp, Unknown
  Ascusbbf_5131D, encodes 16S rRNA
agagtttgatcatggctcaggatgaacgctagctacaggcttaacacatgcaagtcgaggggcagcattagattagcttgctaatctagatggcgaccggcgcacgggtgagtaacgcgtatccaacctgccccctacccggggatagccttgcgaaagtaagattaatacccggtgctgttatgcttccgcatgggaatataacgaaagattcatcggtaggggatggggatgcgtccgattagcttgttggcggggtaacggcccaccaaggcgacgatcggtaggggttctgagagg

SEQ ID NO: 5721 - DNA, 300 bp, Unknown
  Ascusbbf_5131E, encodes 16S rRNA
agagtttgatcctggctcaggatgaacgctagctacaggcttaacacatgcaagtcgaggggcagcattaagtcagcttgctgatttagatggcgaccggcgcacgggtgagtaacgcgtatccaacctgccccctacccggggatagccttgcgaaagtaagattaatacccggtgcagttatgattccgcatgggaatataacgaaagattcatcggtaggggatggggatgcgtccgattagcttgttggcggggtaacggcccaccaaggcgacgatcggtaggggttctgagagg

SEQ ID NO: 5722 - DNA, 300 bp, Unknown; identical to SEQ ID NO: 5718
  Ascusbbf_5131F, encodes 16S rRNA

SEQ ID NO: 5723 - DNA, 300 bp, Unknown
  Ascusbbf_5131G, encodes 16S rRNA
agagtttgatcctggctcaggatgaacgctagctacaggcttaacacatgcaagtcgaggggcagcattaaggaagcttgctttcttagatggcgaccggcgcacgggtgagtaacgcgtatccaacctgccccctacccggggatagccttgcgaaagtaagattaatacccggtgcagttatgattccgcatgggaatataacgaaagattcatcggtaggggatggggatgcgtccgattagcttgttggcggggtaacggcccaccaaggcgacgatcggtaggggttctgagagg

SEQ ID NO: 5724 - DNA, 300 bp, Unknown
  Ascusbbf_5131H, encodes 16S rRNA
agagtttgatcatggctcaggatgaacgctagctacaggcttaacacatgcaagtcgaggggcagcattaagtcagcttgctgatttagatggcgaccggcgcacgggtgagtaacgcgtatccaacctgccccctacccggggatagccttgcgaaagtaagattaatacccggtgctgttatgattccgcatgggaatataacgaaagattcatcggtaggggatggggatgcgtccgattagcttgttggcggggtaacggcccaccaaggcgacgatcggtaggggttctgagagg

SEQ ID NO: 5725 - DNA, 300 bp, Unknown
  Ascusbbf_8600A, encodes 16S rRNA
agagtttgatcctggctcaggacgaacgctggcggcgtgcctaacacatgcaagtcgaacggagctagaaagcttgctttttagcttagtggcggacgggtgagtaatgcgtgagcaacctgcctgtcagtgggggataacttccggaaacggacgctaataccgcatatagtacataatccgcatggataagtgtatgaaaggagcaatccgctgatagatgggctcacgtccgattagtttgttggtggggtaatggcctaccaagactgcgatcggtagccgggctgagaggctgaa

SEQ ID NO: 5726 - DNA, 300 bp, Unknown
  Ascusbbf_8600B, encodes 16S rRNA
agagtttgatcatggctcaggacgaacgctggcggcgtgcctaacacatgcaagtcgaacggagctagaaagcttgctttttagcttagtggcggacgggtgagtaatgcgtgagcaacctgcctgtcagtgggggataacttccggaaacggacgctaataccgcatatagtacataatccgcatggataagtgtatgaaaggagcaatccgctgatagatgggctcacgtccgattagtttgttggtggggtaatggcctaccaagactgcgatcggtagccgggctgagaggctgaa

SEQ ID NO: 5727 - DNA, 299 bp, Unknown
  Ascusbbf_1273A, encodes 16S rRNA
agagtttgatcatggctcaggatgaacgctggcggcgtgcttaacacatgcaagttgtgcggtttctttcgaatgagacttcggtggattttggaagagatagcagcggacgggtgagtaaagcacaaggacgtgccctgaggcgggggacaactacgggaaaccgtagctaataccccgtaagccgagaggtgaaagcagcaatgcgccgaaggagcgacttgtgtcctatcaggtagttggtgaggcaacggctcaccaagccgaagacgggtagccggactgagaggttgtacggc

SEQ ID NO: 5728 - DNA, 299 bp, Unknown
  Ascusbbf_1273B, encodes 16S rRNA
agagtttgatcatggctcaggatgaacgctggcggcgtgcttaacacatgcaagttgtgcggtttctttcaaatgagacttcggtggattttggaagagatagcagcggacgggtgagtaaagcacaaggacgtgccctgaggcgggggacaactacgggaaaccgtagctaataccccgtaagccgagaggtgaaagcagcaatgcgccgaaggagcgacttgtgtcctatcaggtagttggtgaggcaacggctcaccaagccgaagacgggtagccggactgagaagttgtacggc

SEQ ID NO: 5729 - DNA, 299 bp, Unknown
  Ascusbbf_1273C, encodes 16S rRNA
agagtttgatcctggctcaggatgaacgctggcggcgtgcttaacacatgcaagttgtgcggtttctttcgaatgagacttcggtggattttggaagagatagcagcggacgggtgagtaaagcacaaggacgtgccctgaggcgggggacaactacgggaaaccgtagctaataccccgtaagccgagaggtgaaagcagcaatgcgccgaaggagcgacttgtgtcctatcaggtagttggtgaggcaacggctcaccaagccgaagacgggtagccggactgagaggttgtacggc

SEQ ID NO: 5730 - DNA, 299 bp, Unknown
  Ascusbbf_1273D, encodes 16S rRNA
agagtttgatcatggctcaggatgaacgctggcggcgtgcttaacacatgcaagttgggcggtttctttcgaatgagacttcggtggattttggaagagatagcagcggacgggtgagtaaagcacaaggacgtgccctgaggcgggggacaactacgggaaaccgtagctaataccccgtaagccgagaggtgaaagcagcaatgcgccgaaggagcgacttgtgtcctatcaggtagttggtgaggcaacggctcaccaagccgaagacgggtagccggactgagaggttgtacggc

SEQ ID NO: 5731 - DNA, 300 bp, Unknown
  Ascusbbf_39159A, encodes 16S rRNA
agagtttgatcctggctcaggacgaacgctggcggcacgcttaacacatgcaagtcgaacggagataatttgagtttacttagattatcttagtggcggacgggtgagtaacacgtgagcaacctacctttgagagagggatagcttctggaaacggatggtaatacctcataacgtagttttaccgcatgataggactaccaaagatttatcactcaaagatgggctcgcgtctgattagctagatggtgaggtaacggctcaccatggcgacgatcagtagccggactgagaggttga

SEQ ID NO: 5732 - DNA, 300 bp, Unknown
  Ascusbbf_39159B, encodes 16S rRNA
agagtttgatcatggctcaggacgaacgctggcggcacgcttaacacatgcaagtcgaacggagataatttgagtttacttagattatcttagtggcggacgggtgagtaacacgtgagcaacctacctttgagagagggatagcttctggaaacggatggtaatacctcataacgtagttttaccgcatgataggactaccaaagatttatcactcaaagatgggctcgcgtctgattagctagatggtgaggtaacggctcaccatggcgacgatcagtagccggactgagaggttga

SEQ ID NO: 5733 - DNA, 301 bp, Unknown
  Ascusbbf_39159C, encodes 16S rRNA
agagtttgatcctggctcaggacgaacgctggcggcacgcttaacacatgcaagtcgaacggagataatttgagtttacttggattatcttagtggcggacgggtgagtaacacgtgagcaacctgcctttgagagagggatagcttctggaaacggatggtaatacctcataacgtagttttaccgcatgataggactaccaaagatttatcactcaaagatgggctcgcgtctgattagatagttggtgaggtaacggctcaccaagtcgacgatcagtagccggactgagaggttgaa

SEQ ID NO: 5734 - DNA, 300 bp, Unknown
  Ascusbbf_39159D, encodes 16S rRNA
agagtttgatcctggctcaggacgaacgctggcggcacgcttaacacatgcaagtcgaacggagataatttgagtttacttagattatcttagtggcggacgggtgagtaacacgtgagcaacctacctttgagagagggatagcttctggaaacggatggtaatacctcataacgtagttttaccgcatgataggactaccaaagatttatcactcaaagatgggctcgcgtctgattagctagatggtgaggtaacggctcaccatggcgacgatcagtagccgaactgagaggttga

SEQ ID NO: 5735 - DNA, 300 bp, Unknown
  Ascusbbf_318A, encodes 16S rRNA
agagtttgatcctggctcagattgaacgctggcggcaggcttaatacatgcaagtcgaacggtaacggcaggaagcttgcttcctggctgacgagtggcggacgggtgagtaatacctggggagctgcctgaatgagggggacaacacctggaaacgggtgctaataccgcgtaagccctgagggggaaaggccgggcaaccggtcgcattcagatgcgcccaggtgggattagctagttggtggggtaacggcctaccaaggcgacgatctctagctggtctgagaggatgatcagcca

SEQ ID NO: 5736 - DNA, 300 bp, Unknown
  Ascusbbf_318B, encodes 16S rRNA
agagtttgatcctggctcagattgaacgctggcggcaggcttaatacatgcaagtcgaacggtaacggcaggaagcttgcttcctggctgacgagtggcagacgggtgagtaatacctggggagctgcctgaatgagggggacaacacctggaaacgggtgctaataccgcataagccctgagggggaaaggccgggcaaccggtcgcattcagatgcgcccaggtgggattagctagttggtggggtaacggcctaccaaggcgacgatctctagctggtctgagaggatgatcagcca

SEQ ID NO: 5737 - DNA, 300 bp, Unknown
  Ascusbbf_318C, encodes 16S rRNA
agagtttgatcatggctcagattgaacgctggcggcaggcttaatacatgcaagtcgaacggtaacggcaggaagcttgcttcctggctgacgagtggcggacgggtgagtaatacctggggagctgcctgaatgagggggacaacacctggaaacgggtgctaataccgcgtaagccctgagggggaaaggccgggcaaccggtcgcattcagatgcgcccaggtgggattagctagttggtggggtaacggcctaccaaggcgacgatctctagctggtctgagaggatgatcagcca

SEQ ID NO: 5738 - DNA, 300 bp, Unknown; identical to SEQ ID NO: 5550
  Ascusbbf_318D, encodes 16S rRNA

SEQ ID NO: 5739 - DNA, 300 bp, Unknown
  Ascusbbf_318E, encodes 16S rRNA
agagtttgatcatggctcagattgaacgctggcggcaggcttaatacatgcaagtcgaacggtaacagcaggaagcttgcttcctggctgacgagtggcggacgggtgagtaatacctggggagctgcctgaatgagggggacaacacctggaaacgggtgctaataccgcgtaagccctgagggggaaaggctgggcaaccagtcgcattcagatgcgcccaggtgggattagctagttggtggggtaacggcctaccaaggcgacgatctctagctggtctgagaggatgatcagcca

SEQ ID NO: 5740 - DNA, 300 bp, Unknown
  Ascusbbf_7046A, encodes 16S rRNA
agagtttgatcatggctcaggacgaacgctggcggcgtgcttaacacatgcaagtcgagcggtaaggccccttcgggggtacacgagcggcgaacgggtgagtaacacgtgagtaacctgcccctgactctgggataagcctgggaaactgggtctaataccggatatgacctcgtgccgcatggtgtggggtggaaaggtgtttttccggtcagggatgggctcgcggcctatcagcttgttggtggggtaacggcctaccaaggcgatgacgggtagccggcctgagagggcgaccgg

SEQ ID NO: 5741 - DNA, 266 bp, Unknown
  Ascusbbf_1372985A, encodes 16S rRNA
agagtttgatcatggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcggtgacggattggctcgcgtccgattagccagttggcggggcaacggcccacca

SEQ ID NO: 5742 - DNA, 300 bp, Unknown; identical to SEQ ID NO: 5417
  Ascusbbf_1372985B, encodes 16S rRNA

SEQ ID NO: 5743 - DNA, 261 bp, Unknown
  Ascusbbf_1372985C, encodes 16S rRNA
agagtttgatcctggctcaggatgaacgctagctacaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggctgggtcttgaaagtcaaggcggtgacggattggctcgcgtccgattagccagttggcggggcaacggcc

SEQ ID NO: 5744 - DNA, 299 bp, Unknown
  Ascusbbf_1372985D, encodes 16S rRNA
agagtttgatcctggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggctgggtcttgaaagtcaaggcggtgacggattggctcgcgtccgattagccagttggcggggcaacggcccaccaaggcgacgatcggtaggggttctgagaggaagg

SEQ ID NO: 5745 - DNA, 299 bp, Unknown
  Ascusbbf_1372985E, encodes 16S rRNA
agagtttgatcatggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggctgggtcttgaaagtcaaggcggtgacggattggctcgcgtccgattagccagttggcggggcaacggcccaccaaggcgacgatcggtaggggttctgagaggaagg

SEQ ID NO: 5746 - DNA, 299 bp, Unknown
  Ascusbbf_1372985F, encodes 16S rRNA
agagtttgatcctggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggctgggtcttgaaagtcaaggcggcgacggattggctcgcgtccgattagccagttggcggggcaacggcccaccaaggcgacgatcggtaggggttctgagaggaagg

SEQ ID NO: 5747 - DNA, 261 bp, Unknown
  Ascusbbf_1372985I, encodes 16S rRNA
agagtttgatcatggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcggtgacggattggctcgcgtccgattagccagttggcgggggaacggcc

SEQ ID NO: 5748 - DNA, 301 bp, Unknown
  Ascusbbf_1372985L, encodes 16S rRNA
agagtttgatcatggctcagattgaacgctggcggcaggcctaatacatgcaagtcggacggtaacataagaaaagcttgcttttcttgatgacgagtggcggacgggtgagtaagatttgggaaactacctgatagagggggacaacagttggaaacgactgctaataccgcatacaacctcagggtgaaagaagaaattcgctatcagatgtgcccaaacgggattagctagtaggtgaggtaaaggctcacctaggcgacgatctctagctggtctgagaggatgatcagccacattg

SEQ ID NO: 5749 - DNA, 269 bp, Unknown
  Ascusbbf_1372985M, encodes 16S rRNA
agagtttgatcctggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggctgggtcttgaaagtcaaggcggtgacggattggctcgcgtccgattagccagttggcggggcaacggcccacccagg

SEQ ID NO: 5750 - DNA, 253 bp, Unknown
  Ascusbbf_1372985N, encodes 16S rRNA
agagtttgatcctggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcggtgacggattggctcgcggccggttagccaggtggcgggg

SEQ ID NO: 5751 - DNA, 264 bp, Unknown
  Ascusbbf_1372985O, encodes 16S rRNA
agagtttgatcatggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggctgggtcttgaaagtcaaggcggtgacggattggctcgcgtccgattagccagttggcgggggaacggcccac

SEQ ID NO: 5752 - DNA, 253 bp, Unknown
  Ascusbbf_1372985P, encodes 16S rRNA
agagtttgatcctggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcggtgacggatttgctcgcgtccgattagccagttggcgggg

SEQ ID NO: 5753 - DNA, 266 bp, Unknown
  Ascusbbf_1372985Q, encodes 16S rRNA
agagtttgatcctggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcggtgacggattggctcgcgtccgattagcccgttggcggggcaacggcccacca

SEQ ID NO: 5754 - DNA, 253 bp, Unknown
  Ascusbbf_1372985R, encodes 16S rRNA
agagtttgatcctggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcggtgacggattggctcgcggccgattagccagtttgcgggg

SEQ ID NO: 5755 - DNA, 299 bp, Unknown
  Ascusbbf_1372985S, encodes 16S rRNA
agagtttgatcatggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcggtgacggattggctcgcgtccgattagccagttggcggggcaacggcccaccaaggcgacgatcggtaggggttctgagaggaagg

SEQ ID NO: 5756 - DNA, 299 bp, Unknown
  Ascusbbf_1372985T, encodes 16S rRNA
agagtttgatcctggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcggtgacggattggctcgcgtccgattagccagttggcggggcaacggcccaccaaggcgacgatcggtaggggttctgagaggaagg

SEQ ID NO: 5757 - DNA, 301 bp, Unknown
  Ascusbbf_121971A, encodes 16S rRNA
agagtttgatcatggctcaggatgaacgctagcggcaggcttaacacatgcaagtcgaggggcaacgcggtgtagcaatacactggcggcgaccggcggaagggtgcgtaacgcgtgagcaacatgcccgtcacagggggataatccatggaaacgtggtctaacaccgcatagattatagggaggacatcctctttataagaaattcgcaagaaggtgacggattggctcgcgtaacattagccagttggtagggtaacggcctaccaaagcgacgatgtttaggggtcctgagagggag

SEQ ID NO: 5758 - DNA, 300 bp, Unknown
  Ascusbbf_5251A, encodes 16S rRNA
agagtttgatcatggctcagaacgaacgctggcggcgcgtcttaagcatgcaagtcgagcggtaagattggtgcttgcactaatcctagagcggcggactggtgagtaacgcgtgggtgacgtacctctgtgacggggacagctcctagaaataggagataataccggatacgctgcatgttgtcagaggacatgcaggaaaggatcttttgattcgcacagagagcggcccgcgtactattagctagttggtgaggtaacggcccaccaaggcgacgatagttacccggcctaagaggg

SEQ ID NO: 5759 - DNA, 301 bp, Unknown
  Ascusbbf_5251B, encodes 16S rRNA
agagtttgatcatggctcagaacgaacgctggcggcgcgtcttaagcatgcaagtcgagcggtaagattggtgcttgcactaatcctagagcggcggactggtgagtaacgcgtgggtgacgtacctctgtgacggggacagctcctagaaataggagataataccggatacgctgtgtgctgtcagagggcacacaggaaaggatcttttgatccgcacagagagcggcccgcgtactattagctggttggtgaggtaacggcccaccaaggcgacgatagttacccggcctaagagggg

SEQ ID NO: 5760 - DNA, 301 bp, Unknown
  Ascusbbf_5251C, encodes 16S rRNA
agagtttgatcatggctcagaacgaacgctggcggcgcgtcttaagcatgcaagtcgagcggtaagattggtgcttgcactaatcctagagcggcggactggtgagtaacgcgtgggtgacgtacctctgtgacggggacagctcctagaaataggagataataccggatacgctgcatgttgtcagaggacatgcaggaaaggatcttttgattcgcacagagagcggcccgcgtactattagctagttggtgaggtaacggcccaccaaggcgacgatagttacccggcctaagagggg

SEQ ID NO: 5761 - DNA, 300 bp, Unknown
  Ascusbbf_5251D, encodes 16S rRNA
agagtttgatcctggctcagaacgaacgctggcggcgcgtcttaagcatgcaagtcgagcggtaagattggtgcttgcactgatcctagagcggcggactggtgagtaacgcgtgggtgacgtacctctgtgacggggacagctcctagaaataggagataataccggatacgctgtgtgctgtcagagggcacacaggaaaggatcttttgatccgcacagagagcggcccgcgtactattagctggttggtgaggtaacggcccaccaaggcgacgatagttacccggcctaagaggg

SEQ ID NO: 5762 - DNA, 301 bp, Unknown
  Ascusbbf_5251E, encodes 16S rRNA
agagtttgatcctggctcagaacgaacgctggcggcgcgtcttaagcatgcaagtcgagcggtaagattggtgcttgcactaatcctagagcggcggactggtgagtaacgcgtgggtgacgtacctctgtgacggggacagctcctagaaataggagataataccggatacgctgtgtgctgtcagagggcacacaggaaaggatcttttgattcgcacagagagcggcccgcgtactattagctagttggtgaggtaacggcccaccaaggcgacgatagttacccggcctaagagggg

SEQ ID NO: 5763 - DNA, 301 bp, Unknown
  Ascusbbf_5251F, encodes 16S rRNA
agagtttgatcatggctcagaacgaacgctggcggcgcgtcttaagcatgcaagtcgagcggtaagattggtgcttgcactaatcctagagcggcggactggtgagtaacgcgtgggtgacgtacctctgtgacggggacagctcctagaaataggagataataccggatacgctgtgtgcagtcagagtgcacacaggaaaggatcttttgattcgcacagagagcggcccgcgtactattagctagttggtgaggtaacggcccaccaaggcgacgatagttacccggcctaagagggg

SEQ ID NO: 5764 - DNA, 300 bp, Unknown
  Ascusbbf_5251G, encodes 16S rRNA
agagtttgatcatggctcagaacgaacgctggcggcgcgtcttaagcatgcaagtcgagcggtaagattggtgcttgcactaatcctagagcggcggactggtgagtaacgcgtgggtgacgtacctctgtgacggggacagctcctagaaataggagataataccggatacgctgtgtgctgtcagagggtacacaggaaaggatcttttgattcgcacagagagcggcccgcgtactattagctagttggtgaggtaacggcccaccaaggcgacgatagttacccggcctaagaggg

SEQ ID NO: 5765 - DNA, 301 bp, Unknown
  Ascusbbf_100A, encodes 16S rRNA
agagtttgatcctggctcaggatgaacgctagctacaggcttaacacatgcaagtcgaggggaaacgatgagagagcttgctctctcaggcgtcgaccggcgcacgggtgagtaacacgtatccaacctgcctttttccagggaataaccttgcgaaagtaagactaatgccctatgtgtcctttgacggcatcagacgaggacgaaagattcatcggaaagggatggggatgcgcctgattaggcagttggcggggcaacggcccaccaaaccgacgatcagtaggggttctgagaggaa

SEQ ID NO: 5766 - DNA, 300 bp, Unknown
  Ascusbbf_100B, encodes 16S rRNA
agagtttgatcctggctcaggatgaacgctagctacaggcttaacacatgcaagtcgaggggaaacgatgagagagcttgctctctcaggcgtcgaccggcgcacgggtgagtaacacgtatccaacctgcctttttctagggaataaccttgcgaaagtaagactaatgccctatgtgtcctttgacggcatcagacgaggacgaaagatttatcggaagaggatggggatgcgcctgattaggcagttggcggggcaacggcccaccaaaccgacgatcagtaggggttctgagagga

SEQ ID NO: 5767 - DNA, 301 bp, Unknown; identical to SEQ ID NO: 5577
  Ascusbbf_100C, encodes 16S rRNA

SEQ ID NO: 5768 - DNA, 301 bp, Unknown
  Ascusbbf_100D, encodes 16S rRNA
agagtttgatcatggctcaggatgaacgctagctacaggcttaacacatgcaagtcgaggggaaacgatgagagagcttgctctctcaggcgtcgaccggcgcacgggtgagtaacacgtatccaacctgcctttttccagggaataaccttgcgaaagtaagactaatgccctatgtgtcctttgacggcatcagacgaggacgaaagatttatcggaaagggatggggatgcgcctgattaggcagttggcggggtaacggcccaccaaaccgacgatcagtaggggttctgagaggaa

SEQ ID NO: 5769 - DNA, 300 bp, Unknown
  Ascusbbf_100E, encodes 16S rRNA
agagtttgatcctggctcaggatgaacgctagctacaggcttaacacatgcaagtcgaggggaaacgatgagagagcttgctctctcaggcgtcgaccggcgcacgggtgagtaacacgtatccaacctgcctttttccagggaataaccttgcgaaagtaagactaatgccctatgtgtcctttgacggcatcagacgaggacgaaagatttatcggaaagggatggggatgcgcctgattaggcagttggcggggcaacggcccaccaaaccgacgatcagtaggggttctgagagga

SEQ ID NO: 5770 - DNA, 300 bp, Unknown
  Ascusbbf_100F, encodes 16S rRNA
agagtttgatcatggctcaggatgaacgctagctacaggcttaacacatgcaagtcgaggggaaacgatgagagagcttgctctctcaggcgtcgaccggcgcacgggtgagtaacacgtatccaacctgcctttttccagggaataaccttgcgaaagtaagactaatgccctatgtgtccttcgacggcatcagacgaggacgaaagatttatcggaagaggatggggatgcgcctgattaggcagttggcggggcaacggcccaccaaaccgacgatcagtaggggttctgagagga

SEQ ID NO: 5771 - DNA, 300 bp, Unknown
  Ascusbbf_100G, encodes 16S rRNA
agagtttgatcatggctcaggatgaacgctagctacaggcttaacacatgcaagtcgaggggaaacgatgagagagcttgctctctcaggcgtcgaccggcgcacgggtgagtaacacgtatccaacctgcctttttccagggaataaccttgcgaaagtaagactaatgccctatgtgtcctttgacggcatcagacgaggacgaaagatttatcggaagaggatggggatgcgcctgattaggcagttggcggggcaacggcccaccaaaccgacgatcagtaggggttctgagagga

SEQ ID NO: 5772 - DNA, 300 bp, Unknown
  Ascusbbf_20584A, encodes 16S rRNA
agagtttgatcatggctcaggatgaacgctggcggcgtgcctaatacatgcaagtcgaacgaggtgtagcaatacaccgagtggcgaacgggtgagtaacacgtaggtaacctgcccctaagtctgggatacccaggggaaaccttggctaataccggatagcggcggaggggacatcccttccgcacgaaagtcgcgtttgcgacgctttcggatggacctgcggcacattagctagttggcggggcaacggcccaccaaggcgaggatgtgtagccgacctgagagggtgaacggcca

SEQ ID NO: 5773 - DNA, 300 bp, Unknown
  Ascusbbf_20584B, encodes 16S rRNA
agagtttgatcctggctcaggatgaacgctggcggcgtgcctaatacatgcaagtcgaacgaggtgtagcaatacaccgagtggcgaacgggtgagtaacacgtaggtaacctgcccctaagtctgggatacccaggggaaaccttggctaataccggatagcggcggaggggacatcccttccgcacgaaagtcgcgtttgcgacgctttcggatggacctgcggcacattagctagttggcggggcaacggcccaccaaggcgaggatgtgtagccgacctgagagggtgaacggcca

SEQ ID NO: 5774 - DNA, 300 bp, Unknown
  Ascusbbf_4317A, encodes 16S rRNA
agagtttgatcatggctcaggatgaacgctagctacaggcttaacacatgcaagtcgaggggcatcatggagattgcttgcaatttctgatggcgaccggcgcacgggtgagtaacgcgtatccaacctgcctgcaagtagggaatagcccggagaaattcggattaatgccctatgtggccctttgatgacatctgaagagggttaaagattaattgcttgcggatggggatgcgtccgattaggcagacggcggggtaacggcccaccgtgccatcgaacggtaggggttctgagagg

SEQ ID NO: 5775 - DNA, 300 bp, Unknown
  Ascusbbf_4317B, encodes 16S rRNA
agagtttgatcatggctcaggatgaacgctagctacaggcttaacacatgcaagtcgaggggcatcatggagattgcttgcaatttctgatggcgaccggcgcacgggtgagtaacgcgtatccaacctgcctgcaagtagggaatagcccggagaaattcggattaatgccctatgtggccctttgatgacatctgaagagggttaaagattaattgcttgcggatggggatgcgtccgattaggcagacggcggggtaacggcccaccgtgccatcgatcggtaggggttctgagagg

SEQ ID NO: 5776 - DNA, 300 bp, Unknown
  Ascusbbf_4317C, encodes 16S rRNA
agagtttgatcatggctcaggatgaacgctagctacaggcttaacacatgcaagtcgaggggcagcatggagattgcttgcaatctttgatggcgaccggcgcacgggtgagtaacgcgtatccaacctgcctgcaagtagggaatagcccggagaaattcggattaatgccctatgtggccctttgatgacatctgaagagggttaaagattaattgcttgcggatggggatgcgtccgattaggcagacggcggggtaacggcccaccgtgccatcgatcggtaggggttctgagagg

SEQ ID NO: 5777 - DNA, 300 bp, Unknown
  Ascusbbf_4317D, encodes 16S rRNA
agagtttgatcctggctcaggatgaacgctagctacaggcttaacacatgcaagtcgaggggcagcatggagattgcttgcaatctttgatggcgaccggcgcacgggtgagtaacgcgtatccaacctgcctgcaagtagggaatagcccggagaaatccggattaatgtcctatgtggcccttagatgacatctgaagagggttaaagatttatcgcttgcggatggggatgcgtccgattaggcagacggcggggtaacggcccaccgtgccatcgatcggtaggggttctgagagg

SEQ ID NO: 5778 - DNA, 297 bp, Unknown; identical to SEQ ID NO: 5563
  Ascusbbf_4317E, encodes 16S rRNA

SEQ ID NO: 5779 - DNA, 301 bp, Unknown
  Ascusbbf_6A, encodes 16S rRNA
agagtttgatcctggctcaggatgaacgctagctacaggcttaacacatgcaagtcgaggggtaacgacagcgaaagcttgcttttgctgggcgacgaccggcgaatgggtgagtaacgcgtatccaacctgccgcaaagtagggcacagccttgcgaaagtaagattaatgccctatgtgctgttttgaagacatctgatgaacagtaaaggttcaccgctttgcgatggggatgcgtctgattaggttgttggcggggtaacggcccaccaagcccgcgatcagtaggggttctgagag

SEQ ID NO: 5780 - DNA, 301 bp, Unknown
  Ascusbbf_6B, encodes 16S rRNA
agagtttgatcctggctcaggatggacgctagctataggcttaacacatgcaagtcgaggggtaacgacagcgaaagcttgcttttgctgggcgacgaccggcgaatgggtgagtaacgcgtatccaacctgccgcaaagtagggcacagccttgcgaaagtaagattaatgccctatgtgctgtgatgatgacatcagaattgcagtaaaggttcaccgcttcgcgatggggatgcgtctgattaggttgttggcggggtaacggcccaccaagcccgcgatcagtaggggttctgagag

SEQ ID NO: 5781 - DNA, 301 bp, Unknown
  Ascusbbf_6C, encodes 16S rRNA
agagtttgatcatggctcaggatgaacgctagctacaggcttaacacatgcaagtcgaggggtaacgacagcgaaagcttgcttttgctgggcgacgaccggcgaatgggtgagtaacgcgtatccaacctgccgcaaagtagggcacagccttgcgaaagtaagattaatgccctatgtgctgtgatgatgacatcagaattgcagtaaaggttcaccgctttgcgatggggatgcgtctgattaggttgttggcggggtaacggcccaccaagccagcgatcagtaggggttctgagag

SEQ ID NO: 5782 - DNA, 301 bp, Unknown
  Ascusbbf_6D, encodes 16S rRNA
agagttagatcatggctcagggtgaacgctagctacaggcttaacacatgcaagtcgaggggtaacgacagcgaaagcttgcttttgctgggcgacgaccggcgaatgggtgagtaacgcgtatccaacctgccgcaaagtagggcacagccttgcgaaagtaagattaatgccctatgtgctgtgatgaggacatctgaactgcagtaaaggttcaccgctttgcgatggggatgcgtctgattaggttgttggcggggtaacggcccaccaagcccgcgatcagtaggggttctgagag

SEQ ID NO: 5783 - DNA, 301 bp, Unknown
  Ascusbbf_6E, encodes 16S rRNA
agagtttgatcctggctcaggatgaacgctagctacaggcttaacacatgcaagtcgaggggtaacgacagcgaaagcttgcttttgctgggcgacgaccggcgaatgggtgagtaacgcgtatccaacctgccgcaaagtagggcacagccttgcgaaagtaagattaatgccctatgtgctgtgatgatgacatcagaattgcagtaaaggtttaccgctttgcgatggggatgcgtctgattaggttgttggcggggtaacggcccaccaagcccgcgatcagtaggggttctgagag

SEQ ID NO: 5784 - DNA, 301 bp, Unknown
  Ascusbbf_6F, encodes 16S rRNA
agagtttgatcatggctcaggatgaacgctagctacaggcttaacacatgcaagtcgaggggtaacgacagcgaaagcttgcttttgctgggcgacgaccggcgaatgggtgagtaacgcgtatccaacctgccgcaaagtagggcacagccttgcgaaagtaagattaatgccctatgtgctgttttgaagacatctgatgaacagtaaaggttcaccgctttgcgatggggatgcgtctgattaggttgttggcggggtaacggcccaccaagcccgcgatcagtaggggttctgagag

SEQ ID NO: 5785 - DNA, 301 bp, Unknown
  Ascusbbf_6G, encodes 16S rRNA
agagtttgatcatggtcaggatgaacgctagctataggcttaacacatgcaagtcgagggataacgacagcgaaagcttgcttttgctgggcgacgaccggcgaatgggtgagtaacgcgtatccaacctgccgcaaagtagggcacagccttgcgaaagtaagattaatgccctatgtgctgtgatgatgacatcagaattgcagtaaaggttcaccgctttgcgatggggatgcgtctgattaggttgttggcggggtaacggcccaccaagcccgcgatcagtaggggttctgagagg

SEQ ID NO: 5786 - DNA, 301 bp, Unknown; identical to SEQ ID NO: 5489
  Ascusbbf_6H, encodes 16S rRNA

SEQ ID NO: 5787 - DNA, 301 bp, Unknown
  Ascusbbf_6I, encodes 16S rRNA
agatttgatcctggctcaggatgaacgctagctacaggcttaacacatgcaagtcgaggggtaacgacagcgaaagcttgcttttgctggtcgacgaccggcgaatgggtgagtaacgcgtatccaacctgccgcaaagtagggcacagccttgcgaaagtaagattaatgccctatgtgctgtgatgatgacatcagaattgcagtaaaggttcaccgctttgcgatggggatgcgtctgattaggttgttggcggggtaacggcccaccaagcctgcgatcagtaggggttctgagagg

SEQ ID NO: 5788 - DNA, 301 bp, Unknown
  Ascusbbf_6J, encodes 16S rRNA
agagtttgatcatggctcaggatgaacgctagctacaggcttaacacatgcaagtcgaggggtaacgacagcgaaagcttgcttttgctggtcgacgaccggcgaatgggtgagtaacgcgtatccaacctaccgcaaagtagggcacagccttgcgaaagtaaaattaatgccctatgtgctgtgatgatgacatcagaattgcagtaaaggttcaccgctttgcgatggggatgcgtctgattaagttgttggcggggtaacagcccaccaagcctgcgatcagtaggggttctgagag

SEQ ID NO: 5789 - DNA, 300 bp, Unknown
  Ascusbbf_6K, encodes 16S rRNA
agagtttgatcatggctcaggatgaacgctagctacaggcttaacacatgcaagtcgaggggtaacgacagcgaaagcttgcttttgctgggcgacgaccggcgaatgggtgagtaacgcgtatccaacctgccgcaaagtagggcacagccttgcgaaagtaagattaatgccctatgtgctgtgatgaggacatctgaattgcagtaaaggttcaccgctttgcgatggggatgcgtctgattaggttgttggcggggtaacggcccaccaagcccgcgatcagtaggggttctgaga

SEQ ID NO: 5790 - DNA, 300 bp, Unknown
  Ascusbbf_6L, encodes 16S rRNA
agagtttgatcatggctcaggatgaacgctagctacaggcttaacacatgcaagtcgaggggcagcatatagatagcttgctatttatgatggcgaccggcgcacgggtgagtaacgcgtatccaaccttccctatactagagaatagcccggcgaaagtcggattaatgctctatgttcttctttgatggcatctgacgagaagcaaaggtttaccggtataggatggggatgcgtctgattaggttgttggcggggtaacggcccaccaagcctacgatcagtaggggttctgagagg

SEQ ID NO: 5791 - DNA, 300 bp, Unknown
  Ascusbbf_19022A, encodes 16S rRNA
agagtttgatcatggctcaggatgaacgctggcggcgtgcctaatacatgcaagtcgagcgagaaattaagaagaagcgttttcgaacaattcatcttaatggaaagcggcggacgggtgagtaacgcgtaggcaacctgcccttagcagagggatagccattggaaacgatgattaaaacctcataacgctgagataacacatgttatctttgccaaagatttatcggctaaggatgggcctgcgtctgattaactagttggtgaggtaacggctcaccaaggtgacgatcagtagccg

SEQ ID NO: 5792 - DNA, 300 bp, Unknown
  Ascusbbf_19022B, encodes 16S rRNA
agagtttgatcctggctcaggatgaacgctggcggcgtgcctaatacatgcaagtcgagcgagaaattaagaagaagcgttttcgaacaattcatcttaatggaaagcggcggacgggtgagtaacgcgtaggcaacctgcccttagcagagggatagccattggaaacgatgattaaaacctcataacgctgagataacacatgttatctttgccaaagatttatcggctaaggatgggcctgcgtctgattaactagttggtgaggtaacggctcaccaaggtgacgatcagtagccg

SEQ ID NO: 5793 - DNA, 300 bp, Unknown
  Ascusbbf_19022C, encodes 16S rRNA
agagtttgatcatggctcaggatgaacgctggcggcgtgcctaatacatgcaagtcgagcgagaaattaagaagaagcgttttcgaacaattcatcttaatggaaagcggcggacgggtgagtaacgcgtaggcaacctgcccttagcagagggatagccattggaaacgatgattaaaacctcataacgctgagataacacatgttatctttgccaaagatttgtcggctaaggatgggcctgcgtctgattaactagttggtgaggtaacggctcaccaaggtgacgatcagtagccg

SEQ ID NO: 5794 - DNA, 300 bp, Unknown
  Ascusbbf_2624A, encodes 16S rRNA
agagtttgatcctggctcaggatgaacgctggcggcgtgcttaacacatgcaagtcgaacgaagcaatttctcacgatcccttcggggtgacgagttattgactgagtggcggacgggtgagtaacgcgtgggtaacctaccttgtacagggggacaacagttggaaacgactgctaataccgcataagcgcacagcttcgcatgaagcagtgtgaaaagttttttcggtacaagatggacccgcgtctgattagctagttggtgaggtaacggctcaccaaggcgacgatcagtagccg

SEQ ID NO: 5795 - DNA, 300 bp, Unknown
  Ascusbbf_2624B, encodes 16S rRNA
agagtttgatcctggctcaggatgaacgctggcggcgtgcttaacacatgcaagtcgaacgaagcaatttattacgatcccttcggggtgacgatttattgactgagtggcggacgggtgagtaacgcgtgggtaacctaccttgtacagggggataacagttggaaacgactgctaataccgcataagcgcacagcttcgcatgaagcagtgtgaaaagtttttcggtacaagatggacccgcgtctgattagctagttggtgaggtaacggcccaccaaggcgacgatagttacccgg

SEQ ID NO: 5796 - DNA, 300 bp, Unknown
  Ascusbbf_2624C, encodes 16S rRNA
agagtttgatcctggctcaggatgaacgctggcggcgtgcttaacacatgcaagtcgaacgaagcaatttattacaatcccttcggggtgacgatttattgactgagtggcggacgggtgagtaacgcgtgggtaacctaccttgtacagggggataacagttggaaacgactgctaataccgcataagcgcacagcttcgcatgaagcagtgtgaaaagttttttcggtataagatggacccgcgtctgattagctagttggtgaggtaacggcccaccaaggcgacgatcagtagccg

SEQ ID NO: 5797 - DNA, 300 bp, Unknown
  Ascusbbf_2624D, encodes 16S rRNA
agagtttgatcctggctcaggatgaacgctggcggcgtgcttaacacatgcaagtcgaacgaagcaatttattacgatcccttcggggtgacgatttattgactgagtggcggacgggtgagtaacgcgtgggtaacctaccttgtacagggggataacagttggaaacgactgctaataccgcataagcgcacagcttcgcatgaagcagtgtgaaaagttttttcggtataagatggacccgcgtctgattagctagttggtgaggtaacggcccaccaaggcgacgatcagtagccg

SEQ ID NO: 5798 - DNA, 300 bp, Unknown
  Ascusbbf_2624E, encodes 16S rRNA
agagtttgatcatggctcaggatgaacgctggcggcgtgcttaacacatgcaagtcgaacgaagcaacttatcacgatcccttcggggtgacgatttgttgactgagtggcggacgggtgagtaacgcgtgggtaacctaccttgtacagggggacaacagttggaaacgactgctaataccgcataagcgcacagcttcgcatgaagcagtgtgaaaagttttttcggtacaagatggacccgcgtctgattagctagttggtgaggtaacggcccaccaaggcgacgatcagtagccg

SEQ ID NO: 5799 - DNA, 300 bp, Unknown
  Ascusbbf_2624F, encodes 16S rRNA
agagtttgatcatggctcaggatgaacgctggcggcgtgcttaacacatgcaagtcgaacgaagcaatttctcacgatcccttcggggtgacgagttattgactgagtggcggacgggtgagtaacgcgtgggtaacctaccttgtacagggggacaacagttggaaacgactgctaataccgcataagcgcacagcttcgcatgaagcagtgtgaaaagttttttcggtacaagatggacccgcgtctgattagctagttggtgaggtaacggctcaccaaggcgacgatcagtagccg

SEQ ID NO: 5800 - DNA, 300 bp, Unknown
  Ascusbbf_2624G, encodes 16S rRNA
agagtttgatcatggctcaggatgaacgctggcggcgtgcttaacacatgcaagtcgaacgaagcaatttattacgatcccttcggggtgacgatttattgactgagtggcggacgggtgagtaacgcgtgggtaacctaccttgtacagggggataacagttggaaacgactgctaataccgcataagcgcacagcttcgcatgaagcagtgtgaaaagttttttcggtataagatggacccgcgtctgattagctagttggtgaggtaacggcccaccaaggcgacgatcagtagccg

SEQ ID NO: 5801 - DNA, 301 bp, Unknown
  Ascusbbf_3427A, encodes 16S rRNA
agagtttgatcctggctcaggatgaacgctagcggcaggcttaacacatgcaagtcgaggggtaacaggggatgtagcaatacatcctgctgacgaccggcgcacaggtgcgtaacgcgtatgcaacctgcccgcaacaggggtataacggagtgaaaattccactaatcccccatattgtcattaggccgcatggctttatgacgaaaggttattctggttgcggatgggcatgcgtgacattaggtagttggcggggtaacggcccaccaagccgacgatgtctaggggagctgagagg

SEQ ID NO: 5802 - DNA, 301 bp, Unknown; identical to SEQ ID NO: 5448
  Ascusbbf_3427B, encodes 16S rRNA

SEQ ID NO: 5803 - DNA, 301 bp, Unknown
  Ascusbbf_3427C, encodes 16S rRNA
agagtttgatcctggctcaggatgaacgctagcggcaggcttaacacatgcaagtcgaggggtaacaggggatgtagcaatacatcctgctgacgaccggcgcacgggtgcgtaacgcgtatgcaacctgcccgcaacaggggtataacggagtgaaaattccactaatcccccatattgtcattaggccgcatggctttatgacgaaaggttattctggttgcggatgggcatgcgtgacattaggtagttggcggggtaacggcccaccaagccgacgatgtctaggggagctgagagg

SEQ ID NO: 5804 - DNA, 301 bp, Unknown
  Ascusbbf_3427D, encodes 16S rRNA
agagtttgatcatggctcaggatgaacgctagcggcaggcttaacacatgcaagtcgaggggtaacaggggatgtagcaatacatcctgctgacgaccggcgcacgggtgcgtaacgcgtatgcaacctgcccgcaacaggggtataacggagtgaaaattccactaatcccccatattgtcattaggccgcatggccggatgacgaaaggttattctggttgcggatgggcatgcgtgacattaggtagttggcggggtaacggcccaccaagccgacgatgtctaggggagctgagagg

SEQ ID NO: 5805 - DNA, 300 bp, Unknown
  Ascusbbf_3427E, encodes 16S rRNA
agatttgatcctggctcaggatgaacgctagcggcaggcttaacacatgcaagtcgaggggtaacaggggatgtagcaatacgtcctgctgacgaccggcgcacgggtgcgtaacgcgtatgcaacctgcccgcaacaggggtataacggagtgaaaattccactaatcccccatattgtcattaggccgcatggctttatgacgaaaggttattctggttgcggatgggcatgcgtgacattaggtagttggcggggtaacggcccaccaagccgacgatgtctaggggagctgagagg

SEQ ID NO: 5806 - DNA, 300 bp, Unknown
  Ascusbbf_5005A, encodes 16S rRNA
agagtttgatcatggctcaggatgaacgctagctacaggcttaacacatgcaagtcgaggggcagcattgagatagcttgctatttcagatggcgaccggcgcacgggtgagtaacgcgtatccaacctggcccgtagtagggaacagcccggcgaaagtcggattaatgccctatgttctccgacgaagacatctgagttggagcaaagattcatcgctacgggatggggatgcgtctgattaggtagtaggcggggtaacggcccacctagccaacgatcagtaggggttctgagagg

SEQ ID NO: 5807 - DNA, 301 bp, Unknown; identical to SEQ ID NO: 5537
  Ascusbbf_5005B, encodes 16S rRNA

SEQ ID NO: 5808 - DNA, 300 bp, Unknown
  Ascusbbf_69A, encodes 16S rRNA
agagtttgatcatggctcaggatgaacgctagctacaggcttaacacatgcaagtcgaggggcagcattatcgaagcttgctttgatagatggcgaccggcgcacgggtgagtaacgcgtatccaaccttccctatagtagagaatagcccggcgaaagtcggattaatgctctatgttgtatttagaggacatctgaagaataccaaaggtttaccgctataggatggggatgcgtctgattaggtagtaggcggggtaacggcccacctagccgacgatcagtaggggttctgagagg

SEQ ID NO: 5809 - DNA, 300 bp, Unknown
  Ascusbbf_69B, encodes 16S rRNA
agagtttgatcctggctcaggatgaacgctagctacaggcttaacacatgcaagtcgaggggcagcatgatcgaagcttgctttgattgatggcgaccggcgcacgggtgagtaacgcgtatccaaccttccctatagtagagaatagcccggcgaaagtcggattaatgctctatgttgtatttagaagacatctgaagaataccaaaggtttaccgctataggatggggatgcgtctgattaggtagtaggcggggtaacggcccacctagccgacgatcagtaggggttctgagagg

SEQ ID NO: 5810 - DNA, 300 bp, Unknown
  Ascusbbf_69C, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccctatagtagagaatagcccggcgaaagtcggattaatgctctatgttgtatttagaggacatctgaagaataccaaaggttcaccgctataggatggggatgcgtctgattaggtagtaggcggggtaacggcccacctagccgacgatcagtaggggttctgagagg

SEQ ID NO: 5811 - DNA, 301 bp, Unknown
  Ascusbbf_69D, encodes 16S rRNA
agagtttgatcctggctcaggatgaacgctagctacaggcttaacacatgcaagtcgaggagcagcatgatcgaagcttgctttgattgatggcgaccggcgcacgggtgagtaacgcgtatccaaccttccctatagtagagaatagcccggcgaaagtcggattaatgctctatgttgtatttagaggacatctgaagaataccaaaggttcaccgctataggatggggatgcgtctgattaggttgttggcggggtaacggcccaccaagccgacgatcagtaggggttctgagagga

SEQ ID NO: 5812 - DNA, 300 bp, Unknown
  Ascusbbf_69E, encodes 16S rRNA
agagtttgatcatggctcaggatgaacgctagctacaggcttaacacatgcaagtcgaggggcagcatgatcgaagcttgctttgattgatggcgaccggcgcacgggtgagtaacgcgtatccaaccttccctatagtagagaatagcccggcgaaagtcggattaatgctctatgttgtatttagaggacatctgaagaataccaaaggtttaccgctataggatggggatgcgtctgattaggttgttggcggggtaacggcccaccaagccgacgatcagtaggggttctgagagg

SEQ ID NO: 5813 - DNA, 300 bp, Unknown
  Ascusbbf_69F, encodes 16S rRNA
agagtttgatcatggctcaggatgaacgctagctacaggcttaacacatgcaagtcgaggggcagcatgatcgaagcttgctttgattgatggcgaccggcgcacgggtgagtaacgcgtatccaaccttccctatagtagagaatagcccggcgaaagtcggattaatgctctatgttgtatttagaagacatctgaagaataccaaaggtttaccgctataggatggggatgcgtctgattaggtagtaggcggggtaacggcccacctagccgacgatcagtaggggttctgagagg

SEQ ID NO: 5814 - DNA, 301 bp, Unknown
  Ascusbbf_69G, encodes 16S rRNA
agagtttgatcctggctcaggatgaacgctagctacaggcttaacacatgcaagtcgaggggcagcatgatcgaagcttgctttgattgatggcgaccggcgcacgggtgagtaacgcgtatccaaccttccctatagtagagaatagcccggcgaaagtcggattaatgctctatgttgtatttagaggacatctgaagaataccaaaggtttaccgctataggatggggatgcgtctgattaggttgttggcggggtgacggcccactaagcctacgatcagtaggggttctgagagga

SEQ ID NO: 5815 - DNA, 300 bp, Unknown
  Ascusbbf_69H, encodes 16S rRNA
agagtttgatcctggctcaggatgaacgctagctacaggcttaacacatgcaagtcgaggggcagcattatcgaagcttgctttgatagatggcgaccggcgcacgggtgagtaacgcgtatccaaccttccctatagtagagaatagcccggcgaaagtcggattaatgctctatgttgtatttagaagacatctgaagaataccaaaggtttaccgctataggatggggatgcgtctgattaggtagtaggcggggtaacggcccacctagccgacgatcagtaggggttctgagagg

SEQ ID NO: 5816 - DNA, 301 bp, Unknown
  Ascusbbf_69I, encodes 16S rRNA
agagtttgatcctggctcaggatgaacgctagctacaggcttaacacatgcaagtcgaggggcagcatgatcaaagcttgctttgattgatggcgaccggcgcacgggtgagtaacgcgtatccaaccttccctatagtagaggatagcccggcgaaagtcggattaatactctatgttgtatttagatgacatcagaagaataccaaaggtttaccgctataggatggggatgcgtctgattaggtagtcggcggggtaacggcccaccgagccatcgatcagtaggggttctgagagga

SEQ ID NO: 5817 - DNA, 300 bp, Unknown
  Ascusbbf_69J, encodes 16S rRNA
agagtttgatcatggctcaggatgaacgctagctacaggcttaacacatgcaagtcgaggggcagcattatcgaagcttgctttgatagatggcgaccggcgcacgggtgagtaacgcgtatccaaccttccctatagtagagaatagcccggcgaaagtcggattaatgctctatgttgtatttagaagacatctgaagaataccaaaggtttaccgctataggatggggatgcgtctgattaggtagtaggcggggtaacggcccacctagccgacgatcagtaggggttctgagagg

SEQ ID NO: 5818 - DNA, 300 bp, Unknown
  Ascusbbf_8082A, encodes 16S rRNA
agagtttgatcatggctcaggacgaacgctggcggcgtgcttaacacatgcaagtcgaacggggaattttatctcggtagaattcctagtggcgaacgggtgagtaacgcgtaggcaacctgcccttcagacggggacaacatcccgaaaggggtgctaataccggatacgaagctcctgccgcatgacgggagcttgaaaggcgcaaacaagcgccgctgagggatgggcctgcgtccgattagcttgttggtggggtaacggcccaccaaggcgacgatcggtagccggtctgagagg

SEQ ID NO: 5819 - DNA, 300 bp, Unknown
  Ascusbbf_8082B, encodes 16S rRNA
agagtttgatcctggctcaggacgaacgctggcggcgtgcttaacacatgcaagtcgaacggggaattttatctcggtagaattcctagtggcgaacgggtgagtaacgcgtaggcaacctgcccttcagacggggacaacatcccgaaaggggtgctaataccggatacgaagctcctgccgcatgacgggagcttgaaaggcgcaaacaagcgccgctgagggatgggcctgcgtccgattagcttgttggtggggtaacggcccaccaaggcgacgatcggtagccggtctgagagg

SEQ ID NO: 5820 - DNA, 300 bp, Unknown
  Ascusbbf_8082C, encodes 16S rRNA
agagtttgatcctggctcaggacgaacgctggcggcgtgcttaacacatgcaagtcgaacggggaattctgcttcggtggaattcctagtggcgaacgggtgagtaacgcgtaggcaacctgcccttcagacggggacaacatcccgaaaggggtgctaataccggatacgaagctcctgccgcatgacgggagcttgaaaggcgcaaacaagcgccgctgagggatgggcctgcgtccgattagcttgttggtggggtaacggcccaccaaggcgacgatcggtagccggtctgagagg

SEQ ID NO: 5821 - DNA, 300 bp, Unknown
  Ascusbbf_8082D, encodes 16S rRNA
agagtttgatcatggctcaggacgaacgctggcggcgtgcttaacacatgcaagtcgaacggggaattctgcttcggtggaattcctagtggcgaacgggtgagtaacgcgtaggcaacctgcccttcagacggggacaacatcccgaaaggggtgctaataccggatacgaagctcctgccgcatgacgggagcttgaaaggcgcaaacaagcgccgctgagggatgggcctgcgtccgattagcttgttggtggggtaacggcccaccaaggcgacgatcggtagccggtctgagagg

SEQ ID NO: 5822 - DNA, 301 bp, Unknown
  Ascusbbf_8082E, encodes 16S rRNA
agagtttgatcatggctcagattgaacgctggcggcaggcctaatacatgcaagtcgaacggtaacataagaaaagcttgcttttcttgatgacgagtggcggacgggtgagtaatatttgggaagctacctgatagagggggacaacagttggaaacgactgctaataccgcatacagccttagggtgaaagaagaaattcgctatcagatgtgcccaaatgggattagctagtaggtgaggtaaaggctcacctaggcgacgatctctagctggtctgagaggatgatcagccacattg

SEQ ID NO: 5823 - DNA, 300 bp, Unknown
  Ascusbbf_8082F, encodes 16S rRNA
agagtttgatcatggctcaggacgaacgctggcggcgtgcttaacacatgcaagtcgaacggggaattctgcttcggtagaattcctagtggcgaacgggtgagtaacgcgtaggcaacctgcccttcagacggggacaacatcccgaaaggggtgctaataccggatacgaagctcctgccgcatgacgggagcttgaaaggcgcaaacaagcgccgctgagggatgggcctgcgtccgattagcttgttggtggggtaacggcccaccaaggcgacgatcggtagccggtctgagagg

SEQ ID NO: 5824 - DNA, 300 bp, Unknown
  Ascusbbf_8082G, encodes 16S rRNA
agagtttgatcatggctcaggacgaacgctggcggcgtgcttaacacatgcaagccgaacggggaattctgcttcggtagaattcctagtggcgaacgggtgagtaacgcgtaggcaacctgcccttcagacggggacaacatcccgaaaggggtgctaataccggatacgaagctcctgccgcatgacgggagcttgaaaggcgcaaacaagcgccgctgagggatgggcctgcgtccgattagcttgttggtggggtaacggcccaccaaggcgacgatcggtagccggtctgagagg

SEQ ID NO: 5825 - DNA, 301 bp, Unknown
  Ascusbbf_8082H, encodes 16S rRNA
agagtttgatcatggctcaggatgaacgctagcgacaggcctaacacatgcaagtcgaggggcagcgggattgaagcttgctttaattgccggcgaccggcgcacgggtgcgtaacaggtgtgcaatctgtccatagtcggggaatagcccagcgaaagctggattaatgctccatgtgaatcgagaccgcatgattttgatttgaaacgtaaggactatgggtgagcacgcttctgattagatagttggtgaggtaacggctcaccaagtcgacgatcagtaggggttctgagaggaagg

SEQ ID NO: 5826 - DNA, 298 bp, Unknown; identical to SEQ ID NO: 5480
  Ascusbbf_8082I, encodes 16S rRNA

SEQ ID NO: 5827 - DNA, 301 bp, Unknown
  Ascusbbf_95A, encodes 16S rRNA
agagtttgatcatggctcaggatgaacgctagctacaggcttaacacatgcaagtcgaggggcagcgagaaggaagcttgctttctttgtcggcgaccggcgcacgggtgagtaacgcgtatccaaccttccccttagtagggcatagcccggcgaaagtcggattaacaccctatgttatccgaagaggacatctgaattggattaaaggtttaccgctaagggatggggatgcgtctgattaggtagtaggcggggtaacggcccacctagccgacgatcagtaggggttctgagagga

SEQ ID NO: 5828 - DNA, 300 bp, Unknown
  Ascusbbf_95B, encodes 16S rRNA
agagtttgatcctggctcaggatgaacgctagctacaggcttaacacatgcaagtcgaggggcagcgagaggaaagcttgctttccttgtcggcgaccggcgcacgggtgagtaacgcgtatccaaccttccccttagtagggcatagcccggcgaaagtcggattaacaccctatgttatccgaagaggacatctgaattggattaaaggtttaccgctaagggatggggatgcgtctgattaggtagtaggcggggtaacggcccacctagccgacgatcagtaggggttctgagagg

SEQ ID NO: 5829 - DNA, 299 bp, Unknown
  Ascusbbf_95C, encodes 16S rRNA
agagtttgatcatggctcaggatgaacgctagctacaggcttaacacatgcaagtcgaggggcagcgagaggaaagcttgctttccttgtcggcgaccggcgcacgggtgagtaacgcgtatccaaccttccccttagtagggcatagcccggcgaaagtcggattaacaccctatgttatccgaagaggacatctgaattggattaaaggtttaccgctaagggatggggatgcgtctgattaggtagtaggcggggtaacggcccacctagccgacgatcagtaggggttctgagag

SEQ ID NO: 5830 - DNA, 300 bp, Unknown
  Ascusbbf_95D, encodes 16S rRNA
agagtttgatcctggctcaggatgaacgctagctacaggcttaacacatgcaagtcgaggggcagcgagaaggaagcttgctttctttgtcggcgaccggcgcacgggtgagtaacgcgtatccaaccttccccttagtagggcatagcccggcgaaagtcggattaacaccctatgttatccgaagaggacatctgaattggattaaaggtttaccgctaagggatggggatgcgtctgattaggtagtaggcggggtaacggcccacctagccgacgatcagtaggggttctgagagg

SEQ ID NO: 5831 - DNA, 300 bp, Unknown
  Ascusbbf_95E, encodes 16S rRNA
agagtttgatcatggctcaggatgaacgctagctacaggcttaacacatgcaagtcgaggggcagcgagaagaaagcttgctttctttgtcggcgaccggcgcacgggtgagtaacgcgtatccaaccttccccttagtagggcatagcccggcgaaagtcggattaataccctatgttatccgaagaggacatctgaattggattaaagatttatcgctaagggatggggatgcgtctgattaggtagtaggcggggtaacggcccacctagcctacgatcagtaggggttctgagagg

SEQ ID NO: 5832 - DNA, 300 bp, Unknown
  Ascusbbf_95F, encodes 16S rRNA
agagtttgatcatggctcaggatgaacgctagctacaggcttaacacatgcaagtcgaggggcagcgggaagaaagcttgctttctttgccggcgaccggcgcacgggtgagtaacgcgtatccaaccttccccttagtagggcatagcccggcgaaagtcggattaataccctatgttatccgaagaggacatctgaattggattaaagatttatcgctaagggatggggatgcgtctgattaggtagtaggcggggtaacggcccacctagcctacgatcagtaggggttctgagagg

SEQ ID NO: 5833 - DNA, 300 bp, Unknown
  Ascusbbf_95G, encodes 16S rRNA
agagtttgatcctggctcaggatgaacgctagctacaggcttaacacatgcaagtcgaggggcagcgggaagaaagcttgctttctttgccggcgaccggcgcacgggtgagtaacgcgtatccaaccttccccttagtagggcatagcccggcgaaagtcggattaataccctatgttatccgaagaggacatctgaattggattaaagatttatcgctaagggatggggatgcgtctgattaggtagtaggcggggtaacggcccacctagcctacgatcagtaggggttctgagagg

SEQ ID NO: 5834 - DNA, 300 bp, Unknown
  Ascusbbf_95H, encodes 16S rRNA
agagtttgatcctggctcaggatgaacgctagctacaggcttaacacatgcaagtcgaggggcagcgagaagaaagcttgctttctttgtcggcgaccggcgcacgggtgagtaacgcgtatccaaccttccccttagtagggcatagcccggcgaaagtcggattaataccctatgttatccgaagaggacatctgaattggattaaagatttatcgctaagggatggggatgcgtctgattaggtagtaggcggggtaacggcccacctagcctacgatcagtaggggttctgagagg

SEQ ID NO: 5835 - DNA, 301 bp, Unknown
  Ascusbbf_1136A, encodes 16S rRNA
agagtttgatcatggctcaggatgaacgctggcggcgtgcctaacacatgcaagtcgaacggtgtgatgattgaagttttcggacagatatcattacatagtggcggacgggtgagtaacgcgtggagaacctgcactgtactgggggatagcagctggaaacggctggtaataccgcatgagaccacgggagggcatcctcctgaggcaaaagatttatcggtacaggatggatccgcgtttgattagccagttggcggggtaacggcccaccaaagcgacgatcaatagccggcctgag

SEQ ID NO: 5836 - DNA, 301 bp, Unknown
  Ascusbbf_1136B, encodes 16S rRNA
agagtttgatcctggctcaggatgaacgctggcggcgtgcctaacacatgcaagtcgaacggtgtaatgattgaagttttcggacagatttcattacatagtggcggacgggtgagtaacgcgtggagaacctgcactgtactgggggatagcagctggaaacggctggtaataccgcatgagaccacgggagggcatcctcctgaggcaaaagatttatcggtacaggatggatccgcgtttgattagccagttggcggggtaacggcccaccaaagcgacgatcaatagccggcctgag

SEQ ID NO: 5837 - DNA, 301 bp, Unknown
  Ascusbbf_1136C, encodes 16S rRNA
agagtttgatcatggctcaggatgaacgctggcggcgtgcctaacacatgcaagtcgaacggtgtaatgattgaagttttcggacagatatcattatatagtggcggacgggtgagtaacgcgtggagaacctgcactgtactgggggatagcagctggaaacggctggtaataccgcatgagaccacgggagggcatccttctgaggcaaaagatttatcggtacaggatggatccgcgtttgattagccagttggcggggtaacggcccaccaaagcgacgatcaatagccggcctgag

SEQ ID NO: 5838 - DNA, 301 bp, Unknown
  Ascusbbf_1136D, encodes 16S rRNA
agagtttgatcatggctcaggatgaacgctggcggcgtgcctaacacatgcaagtcgaacggtgtaatgattgaagttttcggacagatttcattacatagtggcggacgggtgagtaacgcgtggagaacctgcactgtactgggggatagcagctggaaacggctggtaataccgcatgagaccacgggagggcatcctcctgaggcaaaagatttatcggtacaggatggatccgcgtttgattagccagttggcggggtaacggcccaccaaagcgacgatcaatagccggcctgag

SEQ ID NO: 5839 - DNA, 301 bp, Unknown
  Ascusbbf_1136E, encodes 16S rRNA
agagtttgatcctggctcaggatgaacgctggcggcgtgcctaacacatgcaagtcgaacggtgtgatgattgaagttttcggacagatatcattacatagtggcggacgggtgagtaacgcgtggagaacctgcactgtactgggggatagcagctggaaacggctggtaataccgcatgagaccacgggagggcatcctcctgaggcaaaagatttatcggtacaggatggatccgcgtttgattagccagttggcggggtaacggcccaccaaagcgacgatcaatagccggcctgag

SEQ ID NO: 5840 - DNA, 301 bp, Unknown
  Ascusbbf_1136F, encodes 16S rRNA
agagtttgatcatggctcaggatgaacgctggcggcgtgcctaacacatgcaagtcgaacggtgtaatgattgaagttttcggacagatatcattacatagtggcggacgggtgagtaacgcgtggagaacctgcactgtactgggggatagcagctggaaacggctggtaataccgcatgagaccacgggagggcatcctcctgaggcaaaagatttatcggtacaggatggatccgcgtttgattagccagttggaggggtaacggcccaccaaggcgacgatcagtagccggtctgag

SEQ ID NO: 5841 - DNA, 300 bp, Unknown
  Ascusbbf_2770A, encodes 16S rRNA
agagtttgatcatggctcaggataaacgccggcggcgtgcctaatacatgcaagtcgaacgaggctcttcggagccgagtggcgtacgggtgagtaacacgttggtaacctgccctccagaccggaataccagagagaaatctctgctaatgccggatgacgtcatatggtcgcaagaccacttgaccaaaggcggcaactgccgcgctgaaggatggacctgcgtcgcattagctagttggcgggataatggcccaccaaggcgaggatgcgtagccgagctgagaggctaaacggcca

SEQ ID NO: 5842 - DNA, 300 bp, Unknown
  Ascusbbf_2770B, encodes 16S rRNA
agagtttgatcctggctcaggataaacgccggcggcgtgcctaatacatgcaagtcgaacgaggctcttcggagccgagtggcgtacgggtgagtaacacgttggtaacctgccctccagaccggaataccagagagaaatctctgctaatgccggatgacgtcatatggtcgcaagaccacttgaccaaaggcggcaactgccgcgctgaaggatggacctgcgtcgcattagctagttggcgggataatggcccaccaaggcgaggatgcgtagccgagctgagaggctaaacggcca

SEQ ID NO: 5843 - DNA, 300 bp, Unknown
  Ascusbbf_2770C, encodes 16S rRNA
agagtttgatcctggctcagaatagacgccggcggcgtgcctaatacatgcaagtcgaacgaggctcttcggagccgagtggcgtacgggtgagtaacacgttggtaacctgccctccagaccggaataccagagagaaatctctgctaatgccggatgacgtcatatggtcgcaagaccacttgaccaaaggcggcaactgccgcgctgaaggatggacctgcgtcgcattagctagttggcgggataatggcccaccaaggcgaggatgcgtagccgagctgagaggctaaacggcca

SEQ ID NO: 5844 - DNA, 298 bp, Unknown; identical to SEQ ID NO: 5480
  Ascusbbf_1629A, encodes 16S rRNA

SEQ ID NO: 5845 - DNA, 299 bp, Unknown
  Ascusbbf_1629B, encodes 16S rRNA
agagtttgatcctggctcaggatgaacgctggcggcgtgcctaatacatgcaagtcgagcgaaccacttcggtggtgagcggcgaacgggtgagtaacacgtaggcgatctgcccatcagacggggacaacgattggaaacgatcgctaataccggataggacgaaagtttaaaggtgcttctggcaccgctgatggatgagcctgcggcgcattagctagttggtagggtaaaggcctaccaaggcgacgatgcgtagccgacctgagagggtgaacggccacactgggactgagaca

SEQ ID NO: 5846 - DNA, 301 bp, Unknown; identical to SEQ ID NO: 5396
  Ascusbbf_1629C, encodes 16S rRNA

SEQ ID NO: 5847 - DNA, 301 bp, Unknown
  Ascusbbf_1629D, encodes 16S rRNA
agagtttgatcatggctcaggatgaacgctggcggcgtgcctaatacatgcaagtcgagcgaaccacttcggtggtgagcggcgaacgggtgagtaacacgtaggtgatctgcccatcagacggggacaacgattggaaacgatcgctaataccggataggacgaaagtttaaaggtgcttctggcaccgctgatggatgagcctgcggcgcattagctagttggtagggtaaaggcctaccaaggcgacgatgcgtagccgacctgagagggtgaacggccacactgggactgagacacg

SEQ ID NO: 5848 - DNA, 301 bp, Unknown
  Ascusbbf_1629E, encodes 16S rRNA
agagtttgatcctggctcaggatgaacgctggcggcgtgcctaatacatgcaagtcgagcgaaccacttcggtggtgagcggcgaacgggtgagtaacacgtaggtgatctgcccatcagacggggacaacgattggaaacgatcgctaataccggataggacgaaagtttaaaggtgcttctggcaccgctgatggatgagcctgcggcgcattagctagttggtagggtaaaggcctaccaaggcgacgatcagtagccggcctgagagggcggacggccacattgggactgagacacg

SEQ ID NO: 5849 - DNA, 301 bp, Unknown
  Ascusbbf_1629F, encodes 16S rRNA
agagtttgatcctggctcaggatgaacgctggcggcgtgcctaatacatgcaagtcgagcgaaccacttcggtggtgagcggcgaacgggtgagtaacacgtaggtgatctgcccatcagacgggggcaacgattggaaacgatcgctaatactggataggacgaaagtttaaaggtgcttctggcaccgctgatggatgagcctgcggcgcattagctagttggtagggtaaaggcctaccaaggcgacgatgcgtagccgacctgagagggtgaacggccacactgggactgagacacg

SEQ ID NO: 5850 - DNA, 301 bp, Unknown
  Ascusbbf_1629G, encodes 16S rRNA
agatttgatcctggctcaggatgaacgctggcggcgtgcctaatacatgcaagtcgagcgaaccacttcggtggtgagcggcgaacgggtgagtaacacgtaggtgatctgcccatcagacggggacaacgattggaaacgatcgctaataccggataggacgaaagtttaaaggtgcttctggcaccgctgatggatgagcctgcggcgcattagctagttggtagggtaaaggcctaccaaggcgacgatgcgtagccgacctgagagggtgaacggccacactgggactgagacacgg

SEQ ID NO: 5851 - DNA, 300 bp, Unknown
  Ascusbbf_1821A, encodes 16S rRNA
agagtttgatcctggctcaggataaacgctggcggcgtgcctaatacatgcaagtcgaggggcagcacggagactgcttgcagtctctggtggcgaccggcggatgggtgagtaacgcgtatccaacctgcccgtgacccggggacagccttccgaaaggaagattaatacccgatgttccggcgtgcgcgcatgcgctgcgccggcaaagtttttctgcggtgacggatggggatgcgtctgattaggctgcaggcggggtaacggcccacctggccatcgatcagtaggggttctgag

SEQ ID NO: 5852 - DNA, 300 bp, Unknown
  Ascusbbf_1821B, encodes 16S rRNA
agagtttgatcatggctcaggatgaacgctagctacaggcttaacacatgcaagtcgaggggcagcacggagactgcttgcagtctctggtggcgaccggcggatgggtgagtaacgcgtatccaacctgcccgtgacccggggacagccttccgaaaggaagattaatacccgatgttccggcgtgcgcgcatgcgctgcgccggcaaagtttttctgcggtgacggatggggatgcgtctgattaggcagcaggcggggtaacggcccacctggccatcgatcagtaggggttctgag

SEQ ID NO: 5853 - DNA, 300 bp, Unknown
  Ascusbbf_1821C, encodes 16S rRNA
agagtttgatcatggctcaggatgaacgctagctacaggcttaacacatgcaagtcgaggggcagcacggagactgcttgcagtctctggtggcgaccggcggatgggcgagtaacgcgtatccaacctgcccgtgacccggggacagccttccgaaaggaagattaatacccgatgttccggcgtgcgcgcatgcgctgcgccggcaaagtttttctgcggtgacggatggggatgcgtctgattaggcagcaggcggggtaacggcccacctggccatcgatcagtaggggttctgag

SEQ ID NO: 5854 - DNA, 300 bp, Unknown
  Ascusbbf_1821D, encodes 16S rRNA
agagtttgatcctggctcaggatgaacgctagctacaggcttaacacatgcaagtcgaggggcagcacggagactgcttgcagtctctggtggcgaccggcggatgggtgagtaacgcgtatccaacctgcccgtgacccggggacagccttccgaaaggaagattaatacccgatgttccggcgtgcgcgcatgcgctgcgccggcaaagtttttctgcggtgacggatggggatgcgtctgattaggcagcaggcggggtaacggcccacctggccatcgatcagtaggggttctgag

SEQ ID NO: 5855 - DNA, 300 bp, Unknown
  Ascusbbf_56782A, encodes 16S rRNA
agagtttgatcatggctcaggatgaacgctagctacaggcttaacacatgcaagtcgaggggcagcatgatcgaagcttgctttgattgatggcgaccggcgcacgggtgagtaacgcgtatccaaccttccctatagtagagaatagcccggcgaaagtcggattaatgctctatgttgtatttagaggacatctgaagaataccaaaggtttaccgctataggatggggatgcgtctgattaggtagtaggcggggtaacggcccacctagccgacgatcagtaggggttctgagagg

SEQ ID NO: 5856 - DNA, 300 bp, Unknown
  Ascusbbf_56782B, encodes 16S rRNA
agagtttgatcatggctcaggatgaacgctagctacaggcttaacacatgcaagtcgaggggcagcatgatcaaagcttgctttgattgatggcgaccggcgcacgggtgagtaacgcgtatccaaccttccctatagtagtggatagcccggcgaaagtcggattaatacactatgttgtatttagaggacatctgaagaataccaaaggtttaccgctataggatggggatgcgtctgattagatagtaggcggggtaacggcccacctagtcgacgatcagtaggggttctgagagg

SEQ ID NO: 5857 - DNA, 300 bp, Unknown
  Ascusbbf_56782C, encodes 16S rRNA
agagtttgatcatggctcaggatgaacgctagctacaggcttaacacatgcaagtcgaggggcagcatgatcaaagcttgctttgattgatggcgaccggcgcacgggtgagtaacgcgtatccaaccttccctatagtagtggatagcccggcgaaagtcggattaatacactatgttgtatttagaggacatctgaagaataccaaaggcttgccgctataggatggggatgcgtctgattagatagtaggcggggtaacggcccacctagtcgacgatcagtaggggttctgagagg

SEQ ID NO: 5858 - DNA, 300 bp, Unknown
  Ascusbbf_92A, encodes 16S rRNA
agagtttgatcctggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatatgccgccccctccgcatgggaggggcgggaaagctccggcggggggggatgggcccgcggcctgttagcttgttggcggggcaacggcccaccaaggcgactatgggtagctgggttgagagaccgaccag

SEQ ID NO: 5859 - DNA, 300 bp, Unknown
  Ascusbbf_92B, encodes 16S rRNA
agagtttgatcctggctcaggatgaacgctggcggcgcgcctaacacatgcaagtcgaacggccggacccaccccggtgggcgaggcagtggcgaacggctgagtaacacgtgggcaacctgcccccctccccgggacagcctcgggaaaccgtgggtaataccggatgagccgccccctccgcatgggaggggcgggaaagctccggcggggggggatgggcccgcggcctgttagctagttggcggggcaacggcccaccaaggcgactatgggtagctgggttgagagaccgaccag

SEQ ID NO: 5860 - DNA, 300 bp, Unknown
  Ascusbbf_92C, encodes 16S rRNA
agagtttgatcatggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatactccgccccctccgcatgggaggggcgggaaagctccggcggggggggatgggcccgcggcctgttagctagttggcggggcaacggcccaccaaggcgactatgggtagctgggttgagagaccgaccag

SEQ ID NO: 5861 - DNA, 300 bp, Unknown
  Ascusbbf_92D, encodes 16S rRNA
agagtttgatcctggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatactccgccccctccgcatgggaggggcgggaaagctccggcggggggggatgggcccgcggcctgttagctagttggcggggcaacggcccaccaaggcgactatgggtagctgggttgagagaccgaccag

SEQ ID NO: 5862 - DNA, 300 bp, Unknown
  Ascusbbf_92E, encodes 16S rRNA
agagtttgatcctggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatatgccgccccctccgcatgggaggggcgggaaagctccggcggggggggatgggcccgcggcctgttagctagttggcggggcaacggcccaccaaggcgactatgggtagctgggttgagagaccgaccag

SEQ ID NO: 5863 - DNA, 300 bp, Unknown
  Ascusbbf_92F, encodes 16S rRNA
agagtttgatcatggctcaggatgaacgctggcggcgcgcctaacacatgcaagtcgaacggccggacccaccccggtgggcgaggcagtggcgaacggctgagtaacacgtgggcaacctgcccccctccccgggacagcctcgggaaaccgtgggtaataccggatgagccgccccctccgcatgggaggggcgggaaagctccggcggggggggatgggcccgcggcctgttagctagttggcggggcaacggcccaccaaggcgactatgggtagctgggttgagagaccgaccag

SEQ ID NO: 5864 - DNA, 300 bp, Unknown
  Ascusbbf_92H, encodes 16S rRNA
agagtttgataatggctcgggatgaacgctggcggcgcgcctaacacatgcaagtcgaacggccggacccaccccggtgggcgaggcagtggcgaacggctgagtaacacgtgggcaacctgcccccctccccgggacagcctcgggaaaccgtgggtaataccggatgaaccgccccctccgcatgggaggggcgggaaagctccggcggggggggatgggcccgcggcctgttagctagttggcggggcaacggcccaccaaggtgactatgggtagctgggttgagagaccgaccag

SEQ ID NO: 5865 - DNA, 301 bp, Unknown; identical to SEQ ID NO: 5661
  Ascusbbf_92K, encodes 16S rRNA

SEQ ID NO: 5866 - DNA, 300 bp, Unknown
  Ascusbbf_92L, encodes 16S rRNA
agagtttgatcatggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatactccgccccctccgcatgggaggggcgggaaagctccggcggggggggatgggcccgcggcctgttagctagttggcggggcaacggcccaccaaggcgactatgggtagccggcctgagagggcggacgg

SEQ ID NO: 5867 - DNA, 300 bp, Unknown
  Ascusbbf_118A, encodes 16S rRNA
agagtttgatcctggctcaggatgaacgctagctacaggcttaacacatgcaagtcgaggggcagcatgatttgtgcttgcacagattaatggcgaccggcgcacgggtgagtaacgcgtatccaaccttccctgtactagaggatagcccggcgaaagtcggattaatactctatgttgttcaatgcggacatctaagttgaaccaaaggtttaccggtataggatggggatgcgtctgattaggttgttggcggggtaacggcccaccaagcctacgatcagtaggggttctgagagg

SEQ ID NO: 5868 - DNA, 300 bp, Unknown
  Ascusbbf_118B, encodes 16S rRNA
agagtttgatcatggctcaggatgaacgctagctacaggcttaacacatgcaagtcgaggggcagcatgatttgtgcttgcacagattgatggcgaccggcgcacgggtgagtaacgcgtatccaaccttccctatactagaggatagcccggcgaaagtcggattaatactctatgttgttcaatgcggacatctaagttgaaccaaaggtttaccggtataggatggggatgcgtctgattaggttgttggcggggtaacggcccaccaagcctacgatcagtaggggttctgagagg

SEQ ID NO: 5869 - DNA, 300 bp, Unknown
  Ascusbbf_118C, encodes 16S rRNA
agagtttgatcctggctcaggatgaacgctagctacaggcttaacacatgcaagtcgaggggcagcatgatttgtgcttgcacagattgatggcgaccggcgcacgggtgagtaacgcgtatccaaccttccctatactagaggatagcccggcgaaagtcggattaatactctatgttgttcaatgcggacatctaagttgaaccaaaggtttaccggtataggatggggatgcgtctgattaggttgttggcggggtaacggcccaccaagcctacgatcagtaggggttctgagagg

SEQ ID NO: 5870 - DNA, 300 bp, Unknown
  Ascusbbf_5429A, encodes 16S rRNA
agagtttgatcctggctcagattgaacgctggcggcaggcttaacacatgcaagtcgtacggtaacagagggaagcttgcttctctgctgacgagtggcggacgggtgagtaatgtctgggaagctgcctgcttgagggggatagcggagcgaaagttccgataataccgcgtaagcccgagaggggaaagtgcgggaccgcaaggccgcacgcgagcagatgcgcccagatgggattaggcagttggggaggtaacggctcaccaaaccgatgatctctagctggtttgagaggacaat

SEQ ID NO: 5871 - DNA, 300 bp, Unknown
  Ascusbbf_5429B, encodes 16S rRNA
agagtttgatcatggctcagattgaacgctggcggcaggcttaacacatgcaagtcgtacggtaacagagggaagcttgcttctctgctgacgagtggcggacgggtgagtaatgtctgggaagctgcctgcttgagggggatagcggagcgaaagttccgataataccgcgtaagcccgagaggggaaagtgcgggaccgcaaggccgcacgcgagcagatgcgcccagatgggattaggcagttggggaggtaacggctcaccaaaccgatgatctctagctggtttgagaggacaat

SEQ ID NO: 5872 - DNA, 300 bp, Unknown; identical to SEQ ID NO: 5871
  Ascusbbf_5429C, encodes 16S rRNA

SEQ ID NO: 5873 - DNA, 301 bp, Unknown
  Ascusbbf_5429D, encodes 16S rRNA
agagtttgatcctggctcagattgaacgctggcggcaggcctaatacatgcaagtcgaacggcagcagggggagtgcttgcactccccgctggcgagtggcggacgggtgagtagtgcctgggaagctgcctggcagagggggacaacagctggaaacggctgctgataccgcatattaccccgagggggaaaggagagatccgctgccggatgcgcccaggcgggattagctggttggcggggcaaaggcccaccaaggcgacgatccctagctggtctgagaggatgatcagccacatt

SEQ ID NO: 5874 - DNA, 300 bp, Unknown
  Ascusbbf_3A, encodes 16S rRNA
agagtttgatcctggctcagattgaacgctggcggcaggcttaacacatgcaagtcgtacggtaacagagggaagcttgcttctctgctgacgagtggcggacgggtgagtaatgtctgggaagctgcctgcttgagggggatagcggagcgaaagttccgataataccgcgtaagcccgagaggggaaagtgcgggaccgcaaggccgcacgcgagcagatgcgcccagatgggattaggcagttggggaggtaatggctcaccaaaccgatgatctctagctggtttgagaggacaat

SEQ ID NO: 5875 - DNA, 300 bp, Unknown; identical to SEQ ID NO: 5870
  Ascusbbf_3B, encodes 16S rRNA

SEQ ID NO: 5876 - DNA, 300 bp, Unknown
  Ascusbbf_3C, encodes 16S rRNA
agagtttgatcatggctcagattgaacgctggcggcaggcttaacacatgcaagtcgtacggtaacagagggaagcttgcttctctgctgacgagtggcggacgggtgagtaatgtctgggaagctgcctgcttgagggggatagcggagcgaaagttccgataataccgcgtaagcccgagaggggaaagtgcgggaccgcaaggccgcacgcgagcagatgcgcccagatgggattaggcagttggggaggtaatggctcaccaaaccgatgatctctagctggtttgagaggacaat

SEQ ID NO: 5877 - DNA, 300 bp, Unknown
  Ascusbbf_3D, encodes 16S rRNA
agagtttgatcctggctcagattgaacgctggcggcaggcttaacacatgcaagtcgtacggtaacagagggaagcttgcttctctgctgacgagtggcggacgggtgagtaatgtctgggaagctgcctgcttgagggggatagcggagcgaaagttccgataataccgcgtaagcccgagaggggaaagtgcgggaccgcaaggccgcacgcgagcagatgcgcccagatgggattaggcagttggggaggtaacggctcaccaaaccgatgatccatagccggcctgagagggtgaa

SEQ ID NO: 5878 - DNA, 300 bp, Unknown; identical to SEQ ID NO: 5871
  Ascusbbf_3E, encodes 16S rRNA

SEQ ID NO: 5879 - DNA, 300 bp, Unknown; identical to SEQ ID NO: 5871
  Ascusbbf_3F, encodes 16S rRNA

SEQ ID NO: 5880 - DNA, 299 bp, Unknown
  Ascusbbf_3G, encodes 16S rRNA
agagtttgatcctggctcagattgaacgctggcggcaggcctaacacatgcaagtcgaacggtaacaggaagaagcttgcttctctgctgacgagtggcggacgggtgagtaatgtctgggaagctgcctgcttgagggggatagcggagcgaaagttccgataataccgcgtaagcccgagaggggaaagtgcgggaccgcaaggccgcacgcgagcagatgcgcccagatgggattaggcagttggggaggtaacggctcaccaaaccgatgatctctagctggtttgagaggacga

SEQ ID NO: 5881 - DNA, 300 bp, Unknown
  Ascusbbf_10576A, encodes 16S rRNA
agagtttgatcctggctcaggatgaacgctagctacaggcttaacacatgcaagtcgaggggcagcatgacgatagcttgctattgtcgatggcgaccggcgcacgggtgagtaacgcgtatccaaccttccccatagtagggcatagcccgtagaaatgcggattaataccctatgttttccgaagcagacatctaatttggaacaaaggttcaccgctatgggatggggatgcgtctgattaggttgttggcggggtaacggcccaccaagccatcgatcagtaggggttctgagagg

SEQ ID NO: 5882 - DNA, 301 bp, Unknown; identical to SEQ ID NO: 5661
  Ascusbbf_10576B, encodes 16S rRNA

SEQ ID NO: 5883 - DNA, 300 bp, Unknown
  Ascusbbf_10576C, encodes 16S rRNA
agagtttgatcctggctcaggatgaacgctagctacaggcttaacacatgcaagtcgaggggcagcatgacgatagcttgctattgtcgatggcgaccggcgcacgggtgagtaacgcgtatccaaccttccccatagtagggcatagcccgtagaaatgcggattaataccctatgttttccgaagcagacatctaattcggaacaaaggttcaccgctatgggatggggatgcgtctgattaggttgttggcggggtaacggcccaccaagccatcgatcagtaggggttctgagagg

SEQ ID NO: 5884 - DNA, 301 bp, Unknown
  Ascusbbf_10576D, encodes 16S rRNA
agagtttgatcctggctcaggatgaacgctagctacaggcttaacacatgcaagtcgaggggcagcatgacgatagcttgctattgtcgatggcgaccggcgcacgggtgagtaacgcgtatccaaccttccccatagtagggcatagcccgtagaaatgcggattaataccctatgttttccgaagcagacatctaatttggaacaaaggttcaccgctatgggatggggatgcgtctgattaggttgcaggcggggtaacggcccacctggccatcgatcagtaggggttctgagagga

SEQ ID NO: 5885 - DNA, 300 bp, Unknown
  Ascusbbf_10576E, encodes 16S rRNA
agagtttgatcatggctcaggatgaacgctagctacaggcttaacacatgcaagtcgaggggcagcatgacgatagcttgctatcgtcgatggcgaccggcgcacgggtgagtaacgcgtatccaaccttccccatagtagggcatagcccgtagaaatgcggattaataccctatgttttccgaagcagacatctaatttggaacaaaggttcaccgctatgggatggggatgcgtctgattaggttgttggcggggtaacggcccaccaagccttcgatcagtaggggttctgagagg

SEQ ID NO: 5886 - DNA, 300 bp, Unknown
  Ascusbbf_729A, encodes 16S rRNA
agagtttgatcctggctcaggatgaacgctagctacaggcttaacacatgcaagtcgaggggcatcagggtctgtgcttgcacagattgctggcgaccggcgcacgggtgagtaacgcgtatccaaccttccccttagtagaggatagcccggcgaaagtcggattaatactctatgttgttcaatgcggacatctaagttgaaccaaaggtttaccgctaagggatggggatgcgtctgattaggtagtaggcggggtaacggcccacctagccgacgatcagtaggggttctgagagg

SEQ ID NO: 5887 - DNA, 300 bp, Unknown
  Ascusbbf_729B, encodes 16S rRNA
agagtttgatcctggctcaggatgaacgctagctacaggcttaacacatgcaagtcgaggggcatcagggtctgtgcttgcacagattgctggcgaccggcgcacgggtgagtaacgcgtatccaaccttccccttagtagaggatagcccggcgaaagtcggattaatactctatgttgttcaatgcggacatctaagttgaaccaaaggtttaccgctaagggatggggatgcgtctgattaggtagtaggcggggtaacggcccacctagccaacgatcagtaggggttctgagagg

SEQ ID NO: 5888 - DNA, 300 bp, Unknown
  Ascusbbf_729C, encodes 16S rRNA
agagtttgatcatggctcaggatgaacgctagctacaggcttaacacatgcaagtcgaggggcatcaggatctgtgcttgcacagattgctggcgaccggcgcacgggtgagtaacgcgtatccaaccttccccttagtagaggatagcccggcgaaagtcggattaatactctatgttgttcaatgcggacatctaagttgaaccaaaggtttaccgctaagggatggggatgcgtctgattaggtagtaggcggggtaacggcccacctagccaacgatcagtaggggttctgagagg

SEQ ID NO: 5889 - DNA, 300 bp, Unknown
  Ascusbbf_729D, encodes 16S rRNA
agagtttgatcctggctcaggatgaacgctagctacaggcttaacacatgcaagtcgaggggcatcagggtctgtgcttgcacagattgctggcgaccggcgcacgggtgagtaacgcgtatccaaccttccccttagtagaggatagcccggcgaaagtcggattaatactctatgttgttcaatgcggacatctaagttgaaccaaaggtttaccgctaagggatggggatgcgtctgattaggttgttggcggggtaacggcccaccaagcctacgatcagtaggggttctgagagg

SEQ ID NO: 5890 - DNA, 300 bp, Unknown
  Ascusbbf_729E, encodes 16S rRNA
agagtttgatcatggctcaggatgaacgctagctacaggcttaacacatgcaagtcgaggggcatcaggatctgtgcttgcacagattgctggcgaccggcgcacgggtgagtaacgcgtatccaaccttccccttagtagaggatagcccggcgaaagtcggattaatactctatgttgttcaatgcggacatctaagttgaaccaaaggcttgccgctaagggatggggatgcgtctgattaggttgttggcggggtaacggcccaccaagccatcgatcagtaggggttctgagagg

SEQ ID NO: 5891 - DNA, 300 bp, Unknown
  Ascusbbf_729F, encodes 16S rRNA
agagtttgatcatggctcaggatgaacgctagctacaggcttaacacatgcaagtcgaggggcatcaggatttgtgcttgcacagattgctggcgaccggcgcacgggtgagtaacgcgtatccaaccttccccttagtagaggatagcccggcgaaagtcggattaatactctatgttgttcaatgcggacatctaagttgaaccaaaggtttaccgctaagggatggggatgcgtctgattaggtagtaggcggggtaacggcccacctagccaacgatcagtaggggttctgagagg

SEQ ID NO: 5892 - DNA, 300 bp, Unknown; identical to SEQ ID NO: 5574
  Ascusbbf_201A, encodes 16S rRNA

SEQ ID NO: 5893 - DNA, 300 bp, Unknown
  Ascusbbf_201B, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccctatactagagaatagcccggcgaaagtcggattaatgctctatgttcttctttgatggcatctgacgagaagcaaaggtttaccggtataggatggggatgcgtctgattaggttgttggcggggtaacggcccaccaagcctgcgatcagtaggggttctgagagg

SEQ ID NO: 5894 - DNA, 300 bp, Unknown
  Ascusbbf_201C, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccctatactagagaatagcccggcgaaagtcggattaatgctctatgttcttctttgatggcatctgacgagaagcaaaggtttaccggtataggatggggatgcgtctgattaggttgttggcggggtaacggcccaccaagcctacgatcagtaggggttctgagagg

SEQ ID NO: 5895 - DNA, 300 bp, Unknown; identical to SEQ ID NO: 5574
  Ascusbbf_201D, encodes 16S rRNA

SEQ ID NO: 5896 - DNA, 300 bp, Unknown
  Ascusbbf_201E, encodes 16S rRNA
agatttgatcatggctcaggatgaacgctagctacaggcttaacacatgcaagtcgaggggcagcatatagatagcttgctatttatgatggcgaccggcgcacgggtgagtaacgcgtatccaaccttccctatactagagaatagcccggcgaaagtcggattaatgctctatgttcttctttgatggcatctgacgagaagcaaaggtttaccggtataggatggggatgcgtctgattaggttgttggcggggtaacggcccaccaagcctacgatcagtaggggttctgagagga

SEQ ID NO: 5897 - DNA, 300 bp, Unknown
  Ascusbbf_201F, encodes 16S rRNA
agagtttgatcatggctcaggatgaacgctagctacaggcttaacacatgcaagtcgaggggcagcatatagatagcttgctatttatgatggcgaccggcgcacgggtgagtagcgcgtatccaaccttccctatactagagaatagcccggcgaaagtcggattaatgctctatgttcttctttgatggcatctgacgagaagcaaaggtttaccggtataggatggggatgcgtctgattaggttgttggcggggtaacggcccacctaaccgacgatcagtaggggttctgagagg

SEQ ID NO: 5898 - DNA, 300 bp, Unknown
  Ascusbbf_201G, encodes 16S rRNA
agagtttgatcatggctcaggatgaacgctagctacaggcttaacacatgcaagtcgaggggcagcataacgaaagcttgcttttgttgatggcgaccggcgcacgggtgagtaacgcgtatccaaccttccctatactagagaatagcccggcgaaagtcggattaatgctctatgttcttctttgatggcatctgacgagaagcaaaggtttaccggtataggatggggatgcgtctgattaggtcgttggcggggtaacggcccaccaagcctacgatcagtaggggttctgagagg

SEQ ID NO: 5899 - DNA, 300 bp, Unknown; identical to SEQ ID NO: 5894
  Ascusbbf_201H, encodes 16S rRNA

SEQ ID NO: 5900 - DNA, 301 bp, Unknown
  Ascusbbf_201I, encodes 16S rRNA
agagtttgatcctggctcaggatgaacgctagctacaggcttaacacatgcaagtcgaggggcagcatgaagatgtgcttgcacaactttgatggcgaccggcgcacgggtgagtaacgcgtatccaaccttccctatactagagaatagcccggcgaaagtcggattaatgctctatgttcttctttgatggcatctgacgagaagcaaaggtttaccggtataggatggggatgcgtctgattaggttgttggcggggtaacggcccaccaagcctacgatcagtaggggttctgagag

SEQ ID NO: 5901 - DNA, 300 bp, Unknown; identical to SEQ ID NO: 5735
  Ascusbbf_416A, encodes 16S rRNA

SEQ ID NO: 5902 - DNA, 300 bp, Unknown
  Ascusbbf_416B, encodes 16S rRNA
agagtttgatcctggctcaggatgaacgctagctacaggcttaacacatgcaagtcgaggggcatcatggagtttgcttgcaaactctgatggcgaccggcgcacgggtgagtaacgcgtatccaaccttccctatagtagaggatagcccggcgaaagtcggattaatactctatgttttccgttgcagacatctaagatggaacaaaggcttgccgctataggatggggatgcgtctgattaggtagtcggcggggtaacggcccaccgagccttcgatcagtaggggttctgagagg

SEQ ID NO: 5903 - DNA, 300 bp, Unknown
  Ascusbbf_416C, encodes 16S rRNA
agagtttgatcctggctcaggatgaacgctagctacaggcttaacacatgcaagtcgaggggcatcatggagtttgcttgcaaactctgatggcgaccggcgcacgggtgagtaacgcgtatccaaccttccctatagtagaggatagcccggcgaaagtcggattaatactctatgttttccgttgcagacatctaagatggaacaaaggcttgccgctataggatggggatgcgtctgattaggtagtcggcggggtaacggcccaccgagccatcgatcagtaggggttctgagagg

SEQ ID NO: 5904 - DNA, 301 bp, Unknown
  Ascusbbf_416D, encodes 16S rRNA
agagtttgatcatggctcaggatgaacgctagctacaggcttaacacatgcaagtcgaggggcagcatgaagtttgcttgcaaactttgatggcgaccggcgcacgggtgagtaacgcgtatccaaccttccctatagtagaggatagcccggcgaaagtcggattaatactctatgttttccaatgcagacatctaaaatggaacaaaggtttaccgctataggatggggatgcgtctgattaggtagtcggcggggtaacggcccaccgagccatcgatcagtaggggttctgagagga

SEQ ID NO: 5905 - DNA, 301 bp, Unknown
  Ascusbbf_416E, encodes 16S rRNA
agagtttgatcctggctcaggatgaacgctagctacaggcttaacacatgcaagtcgaggggcagcatgaagtttgcttgcaaactttgatggcgaccggcgcacgggtgagtaacgcgtatccaaccttccctatagtagaggatagcccggcgaaagtcggattaatactctatgttttccaatgcagacatctaaaatggaacaaaggtttaccgctataggatggggatgcgtctgattaggtagtcggcggggtaacggcccaccgagccatcgatcagtaggggttctgagagga

SEQ ID NO: 5906 - DNA, 300 bp, Unknown
  Ascusbbf_416F, encodes 16S rRNA
agagtttgatcatggctcaggatgaacgctagctacaggcttaacacatgcaagtcgaggggcatcatggagtttgcttgcaaactctgatggcgaccggcgcacgggtgagtaacgcgtatccaaccttccctatagtagaggatagcccggcgaaagtcggattaatactctatgttttccgttgcagacatctaagatggaacaaaggcttgccgctataggatggggatgcgtctgattaggtagtcggcggggtaacggcccaccgagccttcgatcagtaggggttctgagagg

SEQ ID NO: 5907 - DNA, 300 bp, Unknown
  Ascusbbf_416G, encodes 16S rRNA
agagtttgatcctggctcaggatgaacgctagctacaggcttaacacatgcaagtcgaggggcatcatggagtttgcttgcaaactctgatggcgaccggcgcacgggtgagtaacgcgtatccaaccttccctatagtagaggatagcccggcgaaagtcggattaatactctatgttttccgttgcagacatctaagatggaacaaaggcttgccgctataggatggggatgcgtctgattaggttgttggcggggtaacggcccaccaagccttcgatcagtaggggttctgagagg

SEQ ID NO: 5908 - DNA, 300 bp, Unknown
  Ascusbbf_15806A, encodes 16S rRNA
agagtttgatcctggctcaggatgaacgctagctacaggcttaacacatgcaagtcgaggggcagcatgatcttagcttgctaagattgatggcgaccggcgcacgggtgagtaacgcgtatccaaccttccctatagtagaggatagcccggcgaaagtcggattaatactctatgttttccgttgcagacatctaaaatggaacaaaggtttaccgctataggatggggatgcgtctgattaggttgttggcggggtaacggcccaccaagccttcgatcagtaggggttctgagagg

SEQ ID NO: 5909 - DNA, 300 bp, Unknown
  Ascusbbf_15806B, encodes 16S rRNA
agagtttgatcctggctcaggatgaacgctagctacaggcttaacacatgcaagtcgaggggcagcatgacgatagcttgctattgttgatggcgaccggcgcacgggtgagtaacgcgtatccaaccttccctatagtagaggatagcccggcgaaagtcggattaatactctatgttttccaatgcagacatctaaaatggaacaaaggtttaccgctataggatggggatgcgtctgattaggttgttggcggggtaacggcccaccaagcctacgatcagtaggggttctgagagg

SEQ ID NO: 5910 - DNA, 299 bp, Unknown
  Ascusbbf_6115A, encodes 16S rRNA
agagtttgatcctggctcaggatgaacgctggcggcgtgcctaacacatgcaagtcgaacggaaatgtttagatgaagttttcggatggattcttttcattttagtggcggacgggtgagtaacacgtgggtaacctgccctgtaccgggggataacacttagaaataggtgataataccgcataagcgcacactgacgcatgtcagagtgtgaaaaactccggtggtacaggatggacccgcgtctgattagcttgttggcggggtaacggcccaccaaggcgacgatcagtagccgg

SEQ ID NO: 5911 - DNA, 299 bp, Unknown
  Ascusbbf_6115B, encodes 16S rRNA
agagtttgatcatggctcaggatgaacgctggcggcgtgcctaacacatgcaagtcgaacggaaatgttttgatgaagatttcggttggattcatttcattttagtggcggacgggtgagtaacacgtgggtaacctgccctgtaccgggggataacacttagaaataggtgataataccgcataagcgcacactgacgcatgtcagagtgtgaaaaactccggtggtacaggatggacccgcgtctgattagcttgttggcggggtaacggcccaccaaggcgacgatcagtagccgg

SEQ ID NO: 5912 - DNA, 299 bp, Unknown
  Ascusbbf_6115C, encodes 16S rRNA
agagtttgatcctggctcaggatgaacgctggcggcgtgcctaacacatgcgagtcgaacggaaatgtttagatgaagttttcggatggattcttttcattttagtggcggacgggtgagtaacacgtgggtaacctgccctgtaccgggggataacacttagaaataggtgataataccgcataagcgcacactgacgcatgtcagagtgtgaaaaactccggtggtacaggatggacccgcgtctgattagcttgttggcggggtaacggcccaccaaggcgacgatcagtagccgg

SEQ ID NO: 5913 - DNA, 299 bp, Unknown
  Ascusbbf_6115D, encodes 16S rRNA
agagtttgatcctggctcaggatgaacgctggcggcgtgcctaacacatgcaagtcgaacggaaatgttttgatgaagatttcggttggattcatttcattttagtggcggacgggtgagtaacacgtgggtaacctgccctgtaccgggggataacacttagaaataggtgataataccgcataagcgcacactgacgcatgtcagagtgtgaaaaactccggtggtacaggatggacccgcgtctgattagcttgttggcggggtaacggcccaccaaggcgacgatcagtagccgg

SEQ ID NO: 5914 - DNA, 301 bp, Unknown
  Ascusbbf_1325058A, encodes 16S rRNA
agagtttgatcctggctcaggacgaacgctggcggcgtgcttaacacatgcaagtcgaacggggcgaagaggagcttgctcttcctagcctagtggcaaacgggtgagtaacgcgtaggcaacctgcccttcagatggggacaacatttcgaaaggaatgctaataccgaatgacgtgcattggtcgcatgaccgatgtaccaaaggccgggcaaccggtcactgaaggatgggcctgcgtctgattagctagttggtggggtaacggctcaccaaggcgacgatcagtagccggtctgag

SEQ ID NO: 5915 - DNA, 301 bp, Unknown
  Ascusbbf_1325058B, encodes 16S rRNA
agagtttgatcatggctcaggacgaacgctggcggcgtgcttaacacatgcaagtcgaacggggcgaagaggagcttgctcttcctagcttagtggcaaacgggtgagtaacgcgtaggcaacctgcccttcagatggggacaacatttcgaaaggaatgctaataccgaatgacgtgcattggtcgcatgaccgatgtaccaaaggccgggcaaccggtcactgaaggatgggcctgcgtctgattagctagttggtggggtaacggcccaccaaggcgacgatcagtagccggtctgag

SEQ ID NO: 5916 - DNA, 301 bp, Unknown
  Ascusbbf_1325058C, encodes 16S rRNA
agagtttgatcatggctcaggaagaacgctggcggcgtgcttaacacatgcaagtcgaacggggcgaagaagagcttgctcttcctagcctagtggcaaacgggtgagtaacgcgtaggcaacctgcccttcagatggggacaacatttcgaaaggaatgctaataccgaatgaagtgcattggccgcatggccgatgcaccaaaggccgggcaaccggtcactgaaggatgggcctgcgtctgattagctagttggtggggtaacggcccaccaaggcgacgatcagtagccggtctgag

SEQ ID NO: 5917 - DNA, 301 bp, Unknown
  Ascusbbf_1325058D, encodes 16S rRNA
agagtttgatcctggctcaggacgaacgctggcggcgtgcttaacacatgcaagtcgaacggggcgaagaggagcttgctcttcctagcctagtggcaaacgggtgagtaacgcgtaggcaacctgcccttcagatggggacaacatttcgaaaggaatgctaataccgaatgacgtgcattggtcgcatgaccgatgtaccaaaggccgggcaaccggtcactgaaggatgggcctgcgtctgattagctagttggtggggtaacggcccaccaaggcgacgatcagtagccggtctgag

SEQ ID NO: 5918 - DNA, 301 bp, Unknown
  Ascusbbf_1325058E, encodes 16S rRNA
agagtttgatcctggctcaggacgaacgctggcggcgtgcttaacacatgcaagtcgaacggggcgaagaagagcttgctcttcctagcctagtggcaaacgggtgagtaacgcgtaggcaacctgcccttcagatggggacaacatttcgaaaggaatgctaataccgaatgaagtgcattggccgcatggccgatgcaccaaaggccgggcaaccggtcactgaaggatgggcctgcgtctgattagctagttggtggggtaacggcccaccaaggcgacgatcagtagccggtctgag

SEQ ID NO: 5919 - DNA, 301 bp, Unknown
  Ascusbbf_1325058F, encodes 16S rRNA
agagtttgatcatggctcaggacgaacgctggcggcgtgcttaacacatgcaagtcgaacggggcgaagaagagcttgctcttcctagcctagtggcaaacgggtgagtaacgcgtaggcaacctgcccttcagatggggacaacatttcgaaaggaatgctaataccgaatgaagtgcattggccgcatggccgatgcaccaaaggccgggcaaccggtcactgaaggatgggcctgcgtctgattagctagttggtggggtaacggcccaccaaggcgacgatcagtagccggtctgag

SEQ ID NO: 5920 - DNA, 300 bp, Unknown
  Ascusbbf_28350A, encodes 16S rRNA
agagtttgatcatggctcaggatgaacgctagctacaggcttaacacatgcaagtcgcggggtaacgagaggaaagcttgctttccttgtcgacgaccggcgcacgggtgagtaacgcgtatccaacctgcccattaccacgggatagcccgtcgaaaggcggattaataccgtatgaacttcatggatggcatctgatatgaagtaaaggtttagcggtaatggatggggatgcgtccgattagatagttggtgaggcaacggctcaccaagtcgacgatcggtaggggttctgagagg

SEQ ID NO: 5921 - DNA, 300 bp, Unknown
  Ascusbbf_28350B, encodes 16S rRNA
agagtttgatcatggctcaggatgaacgctagctacaggcttaacacatgcaagtcgcggggtaacgagaggaaagcttgctttccttgtcgacgaccggcgcacgggtgagtaacgcgtatccaacctgcccattaccacgggatagcccgtcgaaaggcggattaataccgtatgaacttcatggatggcatctgatatgaagtaaaggtttagcggtaatggatggggatgcgtccgattagatagttggtgaggcaacggctcaccaagtcaacgatcggtaggggttctgagagg

SEQ ID NO: 5922 - DNA, 300 bp, Unknown
  Ascusbbf_28350C, encodes 16S rRNA
agagtttgatcctggctcaggatgaacgctagctacaggcttaacacatgcaagtcgcggggtaacgagaggaaagcttgctttccttgtcgacgaccggcgcacgggtgagtaacgcgtatccaacctgcccattaccacgggatagcccgtcgaaaggcggattaataccgtatgaacttcatggatggcatctgatatgaagtaaaggtttagcggtaatggatggggatgcgtccgattagatagttggtgaggcaacggctcaccaagtcgacgatcggtaggggttctgagagg

SEQ ID NO: 5923 - DNA, 301 bp, Unknown
  Ascusbbf_372A, encodes 16S rRNA
agagtttgatcctggctcaggatgaacgctagcgacaggcttaacacatgcaagtcgaggggcagcgggcgagtggcaacacttgctgtcggcgaccggcgcactggtgagtaacacgtatgcaacctgcccccttctgggagataacccatagaaatgtggcctaatatcccatagtcggtccagccgcatggccgggccgggaaaggcgagccggaaggggatgggcatgcggcgcattagctagttggcggggcagaggcccaccaaggcgacgatgcgtaggggttctgagaggaag

SEQ ID NO: 5924 - DNA, 299 bp, Unknown
  Ascusbbf_372B, encodes 16S rRNA
agagtttgatcatggctcaggacgaacgctggcggcgtgcttaacacatgcaagtcgaggggcagcgggcgagtggcaacacttgctgtcggcgaccggcgcactggtgagtaacacgtatgcaacctgcccccttctgggagataacccatagagatgtggcctaatatcccatagtcggtccagccgcatggccgggccgggaaaggcgagccggaaggggatgggcatgcggcgcattagctagttggcggggcagaggcccaccaaggcgacgatgcgtaggggttctgagagga

SEQ ID NO: 5925 - DNA, 301 bp, Unknown
  Ascusbbf_372C, encodes 16S rRNA
agagtttgatcatggctcaggatgaacgctagcgacaggcttaacacatgcaagtcgaggggcagcgggcgagtggcaacactcgctgtcggcgaccggcgcactggtgagtaacacgtatgcaacctgcccccttctgggagataacccatagaaatgtggcctaatatcccatagtcggtccagccgcatggccgggccgggaaaggcgagccggaaggggatgggcatgcggcgcattagctagttggcggggcagaggcccaccaaggcgacgatgcgtaggggttctgagaggaag

SEQ ID NO: 5926 - DNA, 301 bp, Unknown
  Ascusbbf_372D, encodes 16S rRNA
agagtttgatcatggctcaggatgaacgctagcgacaggcttaacacatgcaagtcgaggggcagcgggcgagtggcaacacttgctgtcggcgaccggcgcactggtgagtaacacgtatgcaacctgcccccttctgggagataacccatagaaatgtggcctaatatcccatagtcggcccagccgcatggctgggccgggaaaggcgagccggaaggggatgggcatgcggcgcattagctagttggcggggcagaggcccaccaaggcgacgatgcgtaggggttctgagaggaag

SEQ ID NO: 5927 - DNA, 301 bp, Unknown
  Ascusbbf_372E, encodes 16S rRNA
agagtttgatcctggctcaggatgaacgctagcgacaggcttaacacatgcaagtcgaggggcagcgggcgagtggcaacacttgctgtcggcgaccggcgcactggtgagtaacacgtatgcaacctgcccccttctgggagataacccatagaaatgtggcctaatatcccatagtcggcccagccgcatggccgggccgggaaaggcgagccggaaggggatgggcatgcggcgcattagctagttggcggggcagaggcccaccaaggcgacgatgcgtaggggttctgagaggaag

SEQ ID NO: 5928 - DNA, 301 bp, Unknown
  Ascusbbf_372F, encodes 16S rRNA
agagtttgatcctggctcaggacgaacgctggcggcgtgcttaacacatgcaagtcgaggggcagcgggcgagtggcaacacttgctgtcggcgaccggcgcactggtgagtaacacgtatgcaacctgcccccttctgggagataacccatagaaatgtggcctaatatcccatagtcggcccagccgcatggccgggccgggaaaggcgagccggaaggggatgggcatgcggcgcattagctagttggcggggcagaggcccaccaaggcgacgatgcgtaggggttctgagaggaag

SEQ ID NO: 5929 - DNA, 300 bp, Unknown
  Ascusbbf_372G, encodes 16S rRNA
agagtttgatcctggctcaggatgaacgctagcgacaggcttaacacatgcaagtcgaggggcagcgggcgagtggcaacacttgctgtcggcgaccggcgcactggtgagtaacacgtatgcaacctgcccccttctgggagataacccatagaaatgtggcctaatatcccatagtcggcccagccgcatggccgggccgggaaaggcgagccggaaggggatgggcatgcggcgcattagctagttggcggggcagaggcccaccaaggcgacgatgcgtaggggttctgagaggaa

SEQ ID NO: 5930 - DNA, 301 bp, Unknown
  Ascusbbf_667A, encodes 16S rRNA
agagtttgatcctggctcaggacgaacgctggcggcatgcctaacacatgcaagtcgaacggagattatttcggtaatcttagtggcgaacgggtgagtaacgcgtaggcaacctgccctttagttggggacaacattccgaaaggggtgctaataccgaatgtgatcgcttttccgcatggaagagcgatgaaagatggcctctatttataagctatcgctaaaggatgggcctgcgtctgattagctagttggtggggtaacggcctaccaaggcgacgatcagtagccggtctgagag

SEQ ID NO: 5931 - DNA, 301 bp, Unknown
  Ascusbbf_667B, encodes 16S rRNA
agagtttgatcatggctcaggacgaacgctggcggcatgcctaacacatgcaagtcgaacggagattatttcggtaatcttagtggcgaacgggtgagtaacgcgtaggcaacctgccctttagttggggacaacattccgaaaggggtgctaataccgaatgtgatcgcttttccgcatggaagagcgatgaaagatggcctctatttataagctatcgctaaaggatgggcctgcgtctgattagctagttggtggggtaacggcctaccaaggcgacgatcagtagccggtctgagag

SEQ ID NO: 5932 - DNA, 301 bp, Unknown
  Ascusbbf_1207A, encodes 16S rRNA
agagtttgatcatggctcaggatgaacgctagcgacaggcctaacacatgcaagtcgaggggcagcacgaaggaagcttgctttctttggtggcgaccggcgcacgggtgcgtaacaggtgtgcaatctgtccatagtcggggaatagcccagcgaaagttggattaatgctccatgtgaatcgagaccgcatgatcttgatttgaaacgtaaggactatgggtgagcacgcttctgattagatagttggtgaggtaacggctcaccaagtcgacgatcagtaggggttctgagaggaagg

SEQ ID NO: 5933 - DNA, 300 bp, Unknown
  Ascusbbf_1207B, encodes 16S rRNA
agagtttgatcatggctcaggatgaacgctagcgacaggcctaacacatgcaagtcgaggggcagcgcggaagaagcttgctttttctggcggcgaccggcgcacgggtgcgtaacaggtgtgcaatctgtccatagtcggggaatagcccagcgaaagttggattaatgctccatgtgaatcgagaccgcatgatcttgatttgaaacgtaaggactatgggtgagcacgcttctgattagatagttggtgaggtaacggctcaccaagtcgacgatcagtaggggttctgagaggaag

SEQ ID NO: 5934 - DNA, 300 bp, Unknown
  Ascusbbf_1207C, encodes 16S rRNA
agagtttgatcatggctcaggatgaacgctagcgacaggcctaacacatgcaagtcgaggggcagcgggattgaagcttgctttaattgccggcgaccggcgcacgggtgcgtaacaggtgtgcaatctgtccatagtcggggaatagcccagcgaaagttggattaatgctccatgtgaatcgagaccgcatgattttgatttgaaacgtaaggactatgggtgagcacgcttctgattagatagttggtgaggtaacggctcaccaagtcgacgatcagtaggggttctgagaggaag

SEQ ID NO: 5935 - DNA, 301 bp, Unknown
  Ascusbbf_1207D, encodes 16S rRNA
agagtttgatcatggctcaggatgaacgctagcgacaggcctaacacatgcaagtcgaggggcagcgggattgaagcttgctttaattgccggcgaccggcgcacgggtgcgtaacaggtgtgcaatctgtccatagtcgggggatagcccagcgaaagctgaattaacactccatgtgaatcgagaccgcatgatcttgatttgaaacgcaaggactatgggtgagcacgcttctgattagatagttggtgaggtaacggctcaccaagtcgacgatcagtaggggttctgagaggaagg

SEQ ID NO: 5936 - DNA, 301 bp, Unknown
  Ascusbbf_1207E, encodes 16S rRNA
agagttttatcatggctcaggatgaacgctagctacaggcttaacacatgcaagtcgaggggcagcgggattgaagcttgctttaattgccggcgaccggcgcacgggtgcgtaacaggtgtgcaatctgtccatagtcgggggatagcccagcgaaagctgaattaatgctccatgtgaatcgagaccgcatgattttgatttgaaacgtaaggactatgggtgagcacgcttctgattagatagttggtgaggtaacggctcaccaagtcgacgatcagtaggggttctgagaggaagg

SEQ ID NO: 5937 - DNA, 301 bp, Unknown
  Ascusbbf_1207F, encodes 16S rRNA
agagtttgatcctggctcaggatgaacgctagcgacaggcctaacacatgcaagtcgaggggcagcgcggaagaagcttgctttttctggcggcgaccggcgcacgggtgcgtaacaggtgtgcaatctgtccatagtcggggaatagcccagcgaaagttggattaatgctccatgtgaatcgagaccgcatgatcttgatttgaaacgtaaggactatgggtgagcacgcttctgattagatagttggtgaggtaacggctcaccaagtcgacgatcagtaggggttctgagaggaagg

SEQ ID NO: 5938 - DNA, 301 bp, Unknown
  Ascusbbf_1207G, encodes 16S rRNA
agagtttgatcctggctcaggatgaacgctagcgacaggcctaacacatgcaagtcgaggggcagcgggattgaagcttgctttaattgccggcgaccggcgcacgggtgcgtaacaggtgtgcaatctgtccatagtcggggaatagcccagcgaaagttggattaatgctccatgtgaatcgagaccgcatgattttgatttgaaacgtaaggactatgggtgagcacgcttctgattagatagttggtgaggtaacggctcaccaagtcgacgatcagtaggggttctgagaggaagg

SEQ ID NO: 5939 - DNA, 301 bp, Unknown
  Ascusbbf_1207H, encodes 16S rRNA
agagtttgatcatggctcaggatgaacgctagcgacaggcctaacacatgcaagtcgaggggcagcgggattgaagcttgctttaattgccggcgaccggcgcacgggtgcgtaacaggtgtgcaatctgtccatagtcggggaatagcccagcgaaagttggattaatgctccatgtgaatcgagaccgcatgatcttgatttgaaacgtaaggactatgggtgagcacgcttctgattagatagttggtgaggtaacggctcaccaagtcgacgatcagtaggggttctgagaggaagg

SEQ ID NO: 5940 - DNA, 301 bp, Unknown
  Ascusbbf_1207I, encodes 16S rRNA
agagtttgatcatggctcaggatgaacgctagcgacaggcctaacacatgcaagtcgaggggcagcgggattgaagcttgctttaattgccggcgaccggcgcacgggtgcgtaacaggtgtgcaatctgtccatagtcggggaatagcccagcgaaagttggattaatgctccatgtgaatcgagaccgcatgattttgatttgaaacgtaaggactatgggtgagcacgcttctgattagatagttggtgaggtaacggctcaccaagtcgacgatcagtaggggttctgagaggaagg

SEQ ID NO: 5941 - DNA, 301 bp, Unknown
  Ascusbbf_1207J, encodes 16S rRNA
agagtttgatcctggctcaggatgaacgctagcgacaggcctaacacatgcaagtcgaggggcagcgggattgaagcttgctttaattgccggcgaccggcgcacgggtgcgtaacaggtgtgcaatctgtccatagtcggggaatagcccagcgaaagttggattaatgctccatgtgaatcgagaccgcatgattttgatttgaaacgtaaggactatgggtgagcacgcttctgattagatagttggtggggtaacggctcaccaagtcgacgatcagtaggggttctgagaggaagg

SEQ ID NO: 5942 - DNA, 301 bp, Unknown
  Ascusbbf_3875A, encodes 16S rRNA
agagtttgatcctggctcaggatgaacgctggcggcgtgcctaatacatgcaagtcgaacggagtgtgccattgatgaggcttcggcggattcgccggtacacttagtggcggacgggtgagtaacgcgtggataacctgcctcacacagggggatagcagctggaaacggctgataataccgcataagcgcacagtgacgcatgtcacagtgtgaaaaactccggtggtgtgagatggatccgcgtctgattagcttgttggcggggtaacggcccaccaaggcgacgatcagtagccgg

SEQ ID NO: 5943 - DNA, 301 bp, Unknown
  Ascusbbf_3875B, encodes 16S rRNA
agagtttgatcatggctcaggatgaacgctggcggcgtgcctaatacatgcaagtcgaacggagtgtgccattgatgaggcttcggcggattcgccggtacacttagtggcggacgggtgagtaacgcgtggataacctgcctcacacagggggatagcagctggaaacggctgataataccgcataagcgcacggtgacgcatgtcacagtgtgaaaaactccggtggtgtgagatggatccgcgtctgattagcttgttggcggggtaacggcccaccaaggcgacgatcagtagccgg

SEQ ID NO: 5944 - DNA, 301 bp, Unknown
  Ascusbbf_3875C, encodes 16S rRNA
agagtttgatcctggctcaggatgaacgctggcggcgtgcctaatacatgcaagtcgaacggagtgtgccattgatgaagcttcggcggattcgccggtacacttagtggcggacgggtgagtaacgcgtggataacctgcctcacacagggggatagcagctggaaacggctgataataccgcataagcgcacagtgacgcatgtcacagtgtgaaaaactccggtggtgtgagatggatccgcgtctgattagcttgttggcggggtaacggcccaccaaggcgacgatcagtagccgg

SEQ ID NO: 5945 - DNA, 301 bp, Unknown
  Ascusbbf_3875D, encodes 16S rRNA
agagtttgatcatggctcaggatgaacgctggcggcgtgcctaatacatgcaagtcgaacggagtgtgccattgatgaagcttcggcagattcgccggtacacttagtggcggacgggtgagtaacgcgtggataacctgcctcacacagggggatagcagctggaaacggctgataataccgcataagcgcacagtgacgcatgtcacagtgtgaaaaactccggtggtgtgagatggatccgcgtctgattagcttgttggcggggtaacggcccaccaaggcgacgatcagtagccgg

SEQ ID NO: 5946 - DNA, 300 bp, Unknown
  Ascusbbf_72889A, encodes 16S rRNA
agagtttgatcatggctcaggatgaacgctggcggcgtgcctaacacatgcaagtcgagcggaccttagagagtgaacagcttgctgggatctttcgaaaggttagcggcggacgggtgagtaacgcgtgggtaacctgcctcatacagggggatagcagttggaaacgactggtaataccgcataagcgcacagtgccgcatggtacggtgtgaaaaactccggtggtatgagatggacccgcgtccgattagccagttggcggggtaacggcccaccaaagcgacgatcggtagccgg

SEQ ID NO: 5947 - DNA, 300 bp, Unknown
  Ascusbbf_72889B, encodes 16S rRNA
agagtttgatcctggctcaggatgaacgctggcggcgtgcctaacacatgcaagtcgagcggaccttagagagtgaacagcttgctgggatcttttgaaaggttagcggcggacgggtgagtaacgcgtgggtaacctgcctcatacagggggatagcagttggaaacgactggtaataccgcataagcgcacagtaccgcatggtacggtgtgaaaaactccggtggtatgagatggacccgcgtccgattagccagttggcggggtaacggcccaccaaagcgacgatcggtagccgg

SEQ ID NO: 5948 - DNA, 301 bp, Unknown
  Ascusbbf_106863A, encodes 16S rRNA
agagtttgatcctggctcaggatgaacgctagcgacaggcttaacacatgcaagtcgaggggcagcgcgagggtagcaatacctttggcggcgaccggcgcactggtgagtaacacgtatgcgacctgccccggacagggggataaacccgggaaactgggcctaataccccatacgcctattggccgcatggtccttaggtgaaagatccgtcggtccgggatgggcatgcggcgcattagcttgttggcggggcaacggcccaccaaggcgacgatgcgtaggggttctgagaggaagg

SEQ ID NO: 5949 - DNA, 301 bp, Unknown
  Ascusbbf_106863B, encodes 16S rRNA
agagtttgatcctggctcaggatgaacgctagcgacaggcttaacacatgcaagtcgaggggcagcgcgggggtagcaatacctttggcggcgaccggcgcactggtgagtaacacgtatgcgacctgccccggacagggggataaacccgggaaactgggcctaataccccataggccttccgaccgcatggtcggtaggtgaaagatccgtcggtccgggatgggcatgcggcgcattagcttgttggcggggcaacggcccaccaaggcgacgatgcgtaggggttctgagaggaagg

SEQ ID NO: 5950 - DNA, 300 bp, Unknown
  Ascusbbf_120B, encodes 16S rRNA
agagtttgatcctggctcaggatgaacgctagctacaggcttaacacatgcaagtcgaggggcagcatattggtagcttgctactaatgatggcgaccggcgcacgggtgagtaacgcgtatccaaccttccctatactagaggatagcccggcgaaagtcggattaatactctatgttcttcgtagatgacatctgaaatgaagcaaagatttatcggtataggatggggatgcgtctgattaggttgttggcggggtaacggcccaccaagcccgcgatcagtaggggttctgagagg

SEQ ID NO: 5951 - DNA, 300 bp, Unknown
  Ascusbbf_120C, encodes 16S rRNA
agagtttgatcctggctcaggatgaacgctagctacaggcttaacacatgcaagtcgaggggcagcatattggtagcttgctactaatgatggcgaccggcgcacgggtgagtaacgcgtatccaaccttccctatactagaggatagcccggcgaaagtcggattaatactctatgttcttcgtagatgacatctgaaatgaagcaaagatttatcggtataggatggggatgcgtctgattaggttgttggcggggtaacggcccaccaagcctgcgatcagtaggggttctgagagg

SEQ ID NO: 5952 - DNA, 301 bp, Unknown
  Ascusbbf_1207K, encodes 16S rRNA
agagtttgatcatggctcaggatgaacgctagcgacaggcctaacacatgcaagtcgaggggcagcgggattgaagcttgctttaattgccggcgaccggcgcacgggtgcgtaacaggtgtgcaatctgtccatagtcggggaatagcccagcgaaagttggattaatgctccatgtgaatcgaagccgcatgactttgatttgaaacgtaaggactatgggtgagcacgcttctgattagatagttggtgaggtaacggctcaccaagtcgacgatcagtaggggttctgagaggaagg

SEQ ID NO: 5953 - DNA, 301 bp, Unknown
  Ascusbbf_1207L, encodes 16S rRNA
agagtttgatcctggctcaggatgaacgctagcgacaggcctaacacatgcaagtcgaggggcagcgggattgaagcttgctttaattgccggcgaccggcgcacgggtgcgtaacaggtgtgcaatctgtccatagtcggggaatagcccagcgaaagttggattaatgctccatgtgaatcgaagccgcatgactttgatttgaaacgtaaggactatgggtgagcacgcttctgattagatagttggtgaggtaacggctcaccaagtcgacgatcagtaggggttctgagaggaagg

SEQ ID NO: 5954 - DNA, 300 bp, Unknown
  Ascusbbf_930A, encodes 16S rRNA
agagtttgatcctggctcaggatgaacgctagctacaggcttaacacatgcaagtcgaggggcagcatgatcttagcttgctaagattgatggcgaccggcgcacgggtgagtaacgcgtatccaaccttccctgtactaggggatagcccggcgaaagtcggattaataccctatgttttccgaagcgagcatttaatttggaacaaaggtttaccggtataggatggggatgcgtctgattagatagtaggcggggtaacggcccacctagtcgacgatcagtaggggttctgagagg

SEQ ID NO: 5955 - DNA, 300 bp, Unknown
  Ascusbbf_915A, encodes 16S rRNA
agagtttgatcctggctcaggatgaacgctagctacaggcttaacacatgcaagtcgaggggcagcatgaagtcagcttgctgactttgatggcgaccggcgcacgggtgcgtaacacgtatccaatctacccatggctcagggatagcctttcgaaagaaagattaatacctgatggtcttacatggagacatctcctagtaagtaaagattaatcggcgatggatgaggatgcgtctgattagatagtaggcggggtaacggcccacctagtcgacgatcagtaggggttctgagagg

SEQ ID NO: 5956 - DNA, 300 bp, Unknown
  Ascusbbf_8941A, encodes 16S rRNA
agagtttgatcatggctcaggatgaacgctagctacaggcttaacacatgcaagtcgaggggcagcatgggggttgcttgcaactcccgatggcgaccggcgcacgggtgagtaacgcgtatccaaccttccccatagtaggggatagcccgtagaaatgcggattaataccctatgttctccgaagaggacatctgatttggagtaaagatttatcgctatgggatggggatgcgtctgattaggctgcaggcggggtaacggcccacctggcctacgatcagtaggggttctgagagg

SEQ ID NO: 5957 - DNA, 301 bp, Unknown; identical to SEQ ID NO: 5915
  Ascusbbf_8480B, encodes 16S rRNA

SEQ ID NO: 5958 - DNA, 300 bp, Unknown
  Ascusbbf_374B, encodes 16S rRNA
agagtttgatcctggctcaggatgaacgctagctacaggcttaacacatgcaagtcgaggggcagcatagcggaagcttgcttctgctgatggcgaccggcgcacgggtgagtaacgcgtatccaaccttccctacagtaggggatagcccggcgaaagtcggattaataccctatgttcttcttcgatgacatctgacgagaagcaaaggttcaccgctataggatggggatgcgtctgattagcttgttggcggggtaacggcccaccaaggctacgatcagtaggggttctgagagg

SEQ ID NO: 5959 - DNA, 300 bp, Unknown
  Ascusbbf_6906A, encodes 16S rRNA
agagtttgatcatggctcaggatgaacgctagctacaggcttaacacatgcaagtcgaggggcagcgaagagttagcttgctaattctgtcggcgaccggcgcacgggtgagtaacgcgtatccaaccttccccttagtagggcatagcccggcgaaagtcggattaataccctatgttgttcatcgcaggcatctaaagtgaaccaaagatttattgctaagggatggggatgcgtctgattaggttgttggcggggtaacggcccaccaagccttcgatcagtaggggttctgagagg

SEQ ID NO: 5960 - DNA, 300 bp, Unknown
  Ascusbbf_6906B, encodes 16S rRNA
agagttgatcctggctcgggatgaacgctagctacaggcttaacacatgcaagtcgaggggcagcgaagagttagcttgctaattctgtcggcgaccggcgcacgggtgagtaacgcgtatccaaccttccccttagtagggcatagcccggcgaaagtcggattaataccctatgttgttcatcgcaggcatctaaagtgaaccaaagatttattgctaagggatggggatgcgtctgattaggttgttggcggggtaacggcccaccaagccatcgatcagtaggggttctgagagga

SEQ ID NO: 5961 - DNA, 301 bp, Unknown
  Ascusbbf_6906D, encodes 16S rRNA
agagtttgatcctggctcaggatgaacgctagctacaggcttaacacatgcaagtcgaggggcagcgaagagttagcttgctaattctgtcggcgaccggcgcacgggtgagtaacgcgtatccaaccttccccttagtagggcatagcccggcgaaagtcggattaataccctatgttgttcatcgcaggcatctaaagtgaaccaaagatttattgctaagggatggggatgcgtctgattaggttgttggcggggtaacggcccaccaagccctcgatcagtaggggtcctgagagga

SEQ ID NO: 5962 - DNA, 300 bp, Unknown
  Ascusbbf_6906E, encodes 16S rRNA
agagtttgatcctggctcaggatgaacgctagctacaggcttaacacatgcaagtcgaggggcagcgaagagttagcttgctaattctgtcggcgaccggcgcacgggtgagtaacgcgtatccaaccttccccttagtagggcatagcccggcgaaagtcggattaataccctatgttgttcatcgcaggcatctaaagtgaaccaaagatttattgctaagggatggggatgcgtctgattaggttgttggcggggtaacggcccaccaagccctcgatcagtaggggttctgagagg

SEQ ID NO: 5963 - DNA, 300 bp, Unknown
  Ascusbbf_69K, encodes 16S rRNA
agagtttgatcctggctcaggatgaacgctagctacaggcttaacacatgcaagtcgaggggcagcatgatcgaagcttgctttgattgatggcgaccggcgcacgggtgagtaacgcgtatccaaccttccctatagtagagaatagcccggcgaaagtcggattaatgctctatgttgtatttagaggacatctgaagaataccaaaggtttaccgctataggatggggatgcgtctgattaggtagtaggcggggtaacggcccacctagccgacgatcagtaggggttctgagagg

SEQ ID NO: 5964 - DNA, 300 bp, Unknown
  Ascusbbf_69M, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccctatagtagagaatagcccggcgaaagtcggattaatgctctatgttgtatttagaggacatctgaagaataccaaaggtttaccgctataggatggggatgcgtctgattaggtagtaggcggggtaacggcccacctagccgacgatcagtaggggttctgagagg

SEQ ID NO: 5965 - DNA, 300 bp, Unknown; identical to SEQ ID NO: 5812
  Ascusbbf_69N, encodes 16S rRNA

SEQ ID NO: 5966 - DNA, 300 bp, Unknown; identical to SEQ ID NO: 5813
  Ascusbbf_69O, encodes 16S rRNA

SEQ ID NO: 5967 - DNA, 300 bp, Unknown
  Ascusbbf_69P, encodes 16S rRNA
agagtttgatcctggctcaggatgaacgctagctacaggcttaacacatgcaagtcgaggggcagcataacgaaagcttgcttttgttgatggcgaccggcgcacgggtgagtaacgcgtatccaaccttccctatagtagagaatagcccggcgaaagtcggattaatgctctatgttgtatttagaggacatctgaagaataccaaaggtttaccgctataggatggggatgcgtctgattaggttgttggcggggtaacggcccaccaagcctacgatcagtaggggttctgagagg

SEQ ID NO: 5968 - DNA, 300 bp, Unknown
  Ascusbbf_721A, encodes 16S rRNA
agagtttgatcctggctcaggatgaacgctagctacaggcttaacacatgcaagtcgaggggcagcatgattctagcttgctagaattgatggcgaccggcgcacgggtgagtaacgcgtatccaaccttccctatagtagaggatagcccggcgaaagtcggattaatactctatgttgttcaatgcggacatctaagttgaaccaaaggtttaccgctataggatggggatgcgtctgattagatggtaggcggggtaacggcccacctagtcgacgatcagtaggggttctgagagg

SEQ ID NO: 5969 - DNA, 300 bp, Unknown
  Ascusbbf_721B, encodes 16S rRNA
agagtttgatcctggctcaggatgaacgctagctacaggcttaacacatgcaagtcgaggggcagcatgattctagcttgctagaattgatggcgaccggcgcacgggtgagtaacgcgtatccaaccttccctatagtagaggatagcccggcgaaagtcggattaatactctatgttttccaatgaggacatctgagctggaataaaggtttaccgctataggatggggatgcgtctgattagatggtaggcggggtaacggcccacctagtcgacgatcagtaggggttctgagagg

SEQ ID NO: 5970 - DNA, 300 bp, Unknown
  Ascusbbf_721C, encodes 16S rRNA
agagtttgatcatggctcaggatgaacgctagctacaggcttaacacatgcaagtcgaggggcagcatgattctagcttgctagaattgatggcgaccggcgcacgggtgagtaacgcgtatccaaccttccctatagtagaggatagcccggcgaaagtcggattaatactctatgttgttcaatgcggacatctaagttgaaccaaaggtttaccgctataggatggggatgcgtctgattagatggtaggcggggtaacggcccacctagtcgacgatcagtaggggttctgagagg

SEQ ID NO: 5971 - DNA, 301 bp, Unknown
  Ascusbbf_3819A, encodes 16S rRNA
agagtttgatcatggctcaggatgaacgctggcggcgtgcttaacacatgcaagtcgagcgaagctctcttgttgatttcttcggattgaaacaagagatgactgagcggcggacgggtgagtaacgcgtggagaacctgccccgtaccgggggataacagttagaaatgactgctaataccgcataagcgcacactatcgcatgatagagtgtgaaaaactccggtggtacgggatggctccgcgttggattagccagttggcggggtaacggcccaccaaagcgacgatccatagccgg

SEQ ID NO: 5972 - DNA, 301 bp, Unknown
  Ascusbbf_4323A, encodes 16S rRNA
agagtttgatcctggctcaggatgaacgctagctacaggcttaacacatgcaagtcgaggggcagcatgaaggtagcaatacctttgatggcgaccggcgcacgggtgcgtaacacgtatccaatctacccatggctcgggaatagcctttcgaaagaaagattaatgcccgatggtctgtgattgagacatctcgattacagtaaagatttatcggcgatggatgaggatgcgtccgattaggtagtaggcggggtaacggcccacctagccgacgatcggtaggggttctgagaggaag

SEQ ID NO: 5973 - DNA, 301 bp, Unknown; identical to SEQ ID NO: 5628
  Ascusbbf_4323B, encodes 16S rRNA

SEQ ID NO: 5974 - DNA, 301 bp, Unknown
  Ascusbbf_4323C, encodes 16S rRNA
agagtttgatcatggctcaggatgaacgctagctacaggcttaacacatgcaagtcgaggggcagcatgagggtagcaatacctttgatggcgaccggcgcacgggtgcgtaacacgtatccaatctacccatggctctgggatagcctttcgaaagaaagattaataccggatggtctgtgtttgagacatctcgaatgcagtaaagatttatcggcgatggatgaggatgcgtccgattaggtagtaggcggggtaacggcccacctagcctacgatcggtaggggttctgagaggaag

SEQ ID NO: 5975 - DNA, 301 bp, Unknown; identical to SEQ ID NO: 5630
  Ascusbbf_4323D, encodes 16S rRNA

SEQ ID NO: 5976 - DNA, 300 bp, Unknown
  Ascusbbf_6087A, encodes 16S rRNA
agagtttgatcatggctcaggatgaacgctagctacaggcttaacacatgcaagtcgaggggcagcaggattctagcttgctagaattgctggcgaccggcgcacgggtgagtaacgcgtatccaacctggcccttagtagaggatagcccggcgaaagtcggattaatactctatgttctccaatgcgggcatctaatttggagcaaagatttatcgctatgggatggggatgcgtctgattagcttgtcggcggggtaacggcccaccgaggcaacgatcagtaggggttctgagagg

SEQ ID NO: 5977 - DNA, 300 bp, Unknown; identical to SEQ ID NO: 5593
  Ascusbbf_6087B, encodes 16S rRNA

SEQ ID NO: 5978 - DNA, 300 bp, Unknown
  Ascusbbf_6087C, encodes 16S rRNA
agagtttgatcctggctcaggatgaacgctagctacaggcttaacacatgcaagtcgaggggcatcaggattctagcttgctaggattgctggcgaccggcgcacgggtgagtaacgcgtatccaacctggcccttagtagaggatagcccggcgaaagtcggattaatactctatgttctccaatgcgggcatctaatttggagcaaagatttatcgctatgggatggggatgcgtctgattagcttgtcggcggggtaacggcccaccgaggcaacgatcagtagggggtctgagagg

SEQ ID NO: 5979 - DNA, 300 bp, Unknown
  Ascusbbf_8414A, encodes 16S rRNA
agagtttgatcatggctcaggacgaacgctggcggcgtgcttaacacatgcaagtcgtgcgaggatgtgattggaaggtcttcggaccggaagattgcatccgagcggcggacgggtgagtaacgcgtgagcaacctgccttcaacagggggataacgcatcgaaagatgtgctaataccgcgtaagaccacggcatcacatggtgcaggggtcaaaggagcaatccggttgaagatgggctcgcgtccgattagccagttggtgaggtaacggcccaccaaagcaacgatcggtagccg

SEQ ID NO: 5980 - DNA, 227 bp, Unknown
  Ascusbbf_1372985G, encodes 16S rRNA
agagtttgatcatggctcagattgaacgctggcggcaggcctaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcggtgacggattggct

SEQ ID NO: 5981 - DNA, 225 bp, Unknown
  Ascusbbf_1372985H, encodes 16S rRNA
agagtttgatcctggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggctgggtcttgaaagtcaaggcggtgacggattgg

SEQ ID NO: 5982 - DNA, 214 bp, Unknown
  Ascusbbf_1372985J, encodes 16S rRNA
agagtttgatcatggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcgg

SEQ ID NO: 5983 - DNA, 214 bp, Unknown
  Ascusbbf_1372985K, encodes 16S rRNA
agagtttgatcctggctcaggatgaacgctagcggcaggcttaacacatgcaagtcgaggggcatcgcggggtagcaataccctggcggcgaccggcgaaagggtgcgtaacgcgtgagcgacatgcccgtcacagggggataaccggcggaaacgccgcctaataccccatatgaggccaggccacatggccgggccttgaaagtcaaggcgg

SEQ ID NO: 5984 - DNA, 217 bp, Unknown
  Ascusbbf_92G, encodes 16S rRNA
agagtttgatcatggctcaggatgaacgctggcggcgcgcctaacacatgcaagtcgaacggccggacccaccccggtgggcgaggcagtggcgaacggctgagtaacacgtgggcaacctgcccccctccccgggacagcctcgggaaaccgtgggtaataccggatagaccgccccctccgcatgggaggggcgggaaagctccggcgggggggg

SEQ ID NO: 5985 - DNA, 217 bp, Unknown
  Ascusbbf_92I, encodes 16S rRNA
agagtttgatcctggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatatgccgccccctccgcatgggaggggcgggaaagctccggcgggggggg

SEQ ID NO: 5986 - DNA, 217 bp, Unknown
  Ascusbbf_92J, encodes 16S rRNA
agagtttgatcatggctcaggatgaacgctggcggcgcgcctaacacatgcaagtcgaacggccggacccacctcggtgggcgaggcagtggcgaacggctgagtaacacgtgggcaacctgcccccctccccgggacagcctcgggaaaccgtgggtaataccggatactccgccccctccgcatgggaggggcgggaaagctccggcgggggggg

SEQ ID NO: 5987 - DNA, 300 bp, Unknown
  Ascusbbf_120A, encodes 16S rRNA
agagtttgatcctggctcaggatgaacgctagctacaggcttaacacatgcaagtcgaggggcagcatgatcgaagcttgctttgattgatggcgaccggcgcacgggtgagtaacgcgtatccaaccttccctatactagaggatagcccggcgaaagtcggattaatactctatgttcttcgtagatgacatctgaaatgaagcaaagatttatcggtataggatggggatgcgtctgattaggttgttggcggggtaacggcccaccaagcccgcgatcagtaggggttctgagagg

SEQ ID NO: 5988 - DNA, 300 bp, Unknown; identical to SEQ ID NO: 5443
  Ascusbbf_930B, encodes 16S rRNA

SEQ ID NO: 5989 - DNA, 301 bp, Unknown
  Ascusbbf_8480A, encodes 16S rRNA
agagtttgatcatggctcaggacgaacgctggcggcgtgcttaacacatgcaagtcgaacggagtgaaggggagcttgctccttggaacttagtggcaaacgggtgagtaacgcgtaggcaacctgcccttcagatggggacaacatttcgaaaggaatgctaataccgaatgacgtgcattggtcgcatgaccgatgtaccaaaggccgggcaaccggtcactgaaggatgggcctgcgtctgattagctagttggtggggtaacggcccaccaaggcgacgatcagtagccggtctgag

SEQ ID NO: 5990 - DNA, 300 bp, Unknown
  Ascusbbf_374A, encodes 16S rRNA
agagtttgatcatggctcaggatgaacgctagctacaggcttaacacatgcaagtcgaggggcagcatagcggaagcttgcttctgctgatggcgaccggcgcacgggtgagtaacgcgtatccaaccttccctacagtaggggatagcccggcgaaagtcggattaataccctatgttcttcttcgatgacatctgacgagaagcaaaggttcaccgctataggatggggatgcgtctgattagcttgttggcggggtaacggcccaccaaggcgacgatcagtaggggttctgagagg

SEQ ID NO: 5991 - DNA, 300 bp, Unknown
  Ascusbbf_374C, encodes 16S rRNA
agagtttgatcatggctcaggatgaacgctagctacaggcttaacacatgcaagtcgaggggcagcatagcggaagcttgcttctgctgatggcgaccggcgcacgggtgagtaacgcgtatccaaccttccctacagtaggggatagcccggcgaaagtcggattaataccctatgttcttcttcgatgacatctgacgagaagcaaaggttcaccgctataggatggggatgcgtctgattagcttgttggcggggtaacggcccaccaaggctacgatcagtaggggttctgagagg

SEQ ID NO: 5992 - DNA, 300 bp, Unknown
  Ascusbbf_6906C, encodes 16S rRNA
agagtttgatcctggctcaggatgaacgctagctacaggcttaacacatgcaagtcgaggggcagcgaagagttagcttgctaattctgtcggcgaccggcgcacgggtgagtaacgcgtatccaaccttccccttagtagggcatagcccggcgaaagtcggattaataccctatgttgttcatcgcaggcatctaaagtgaaccaaagatttattgctaagggatggggatgcgtctgattaggttgttggcggggtaacggcccaccaagccttcgatcagtaggggttctgagagg

SEQ ID NO: 5993 - DNA, 527 bp, Unknown
  Ascusbbf_69L, encodes 16S rRNA
agagtttgatcatggctcaggatgaacgctagctacaggcttaacacatgcaagtcgaggggcagcagatcgaaagcttgcttttgatgctggcgaccggcgcacgggtgagtaacgcgtatccaaccttccctatagtagagaatagcccggcgaaagtcgaattaatgctctatgttgtatttagaagacatctgaagaataccaaaggtttaccgctataggatggggatgcgtctgattaggtagtaggcggggtaacggcccacctagccgacgatcagtaggggttctgagaggaaggtcccccacattggaactgagacacggtccaaactcctacgggaggcagcagtgaggaatattggtcaatggacggaagtctgaaccagccaagtagcgtgcaggatgacggccctatgggttgtaaactgcttttatatagggataaagtcggggacgtgtccccgtttgtaggtactatatgaataaggaccggctaattccgtgccagcagccgcggtaat
